(12) United States Patent
Botstein et al.

(10) Patent No.: US 6,913,919 B2
(45) Date of Patent: Jul. 5, 2005

(54) SECRETED AND TRANSMEMBRANE POLYPEPTIDES AND NUCLEIC ACIDS ENCODING THE SAME

(75) Inventors: David Botstein, Belmont, CA (US); Audrey Goddard, San Francisco, CA (US); Paul J. Godowski, Hillsborough, CA (US); Austin L. Gurney, Belmont, CA (US); Margaret Ann Roy, San Francisco, CA (US); William I. Wood, Hillsborough, CA (US)

(73) Assignee: Genetech, Inc., South San Francisco, CA (US)

( * ) Notice: Subject to any disclaimer, the term of this patent is extended or adjusted under 35 U.S.C. 154(b) by 423 days.

(21) Appl. No.: 09/991,181

(22) Filed: Nov. 16, 2001

(65) Prior Publication Data

US 2002/0197615 A1 Dec. 26, 2002

Related U.S. Application Data

(63) Continuation of application No. 09/941,992, filed on Aug. 28, 2001, which is a continuation of application No. PCT/US00/08439, filed on Mar. 30, 2000, which is a continuation-in-part of application No. 09/380,137, filed as application No. PCT/US99/12252 on Jun. 2, 1999.
(60) Provisional application No. 60/141,037, filed on Jun. 23, 1999, and provisional application No. 60/089,600, filed on Jun. 17, 1998.

(51) Int. Cl.[7] ............................. C07K 5/10; C07K 5/16; C07K 15/12; C07K 15/63

(52) U.S. Cl. ............................... 435/252.3; 435/320.1; 435/69.1; 435/254.11; 536/12.1; 536/23.5
(58) Field of Search ........................ 435/320.1, 69.1, 435/325, 252.3, 254.11; 536/23.1, 23.5

(56) References Cited

U.S. PATENT DOCUMENTS 5,618,722 A * 4/1997 Zenno et al. ............ 435/252.3

OTHER PUBLICATIONS

Coleman et al., 2002, J. Nutr. 132:2123–2126.*
Pennica et al., 1998, PNAS USA 95:14717–14722.*
Konopka, 1986, PNAS USA 83:4049–4052.*
Haynes et al., 1998, Electrophoresis 19:1862–1871.*
Dayhoff, Accession No.: P_AAB70158, WO 200107628–A2, Pub Date: Feb. 1, 2001, Tang, Y.T. et al.
GenBank, Accession No.: 140164.

* cited by examiner

Primary Examiner—Elizabeth Kemmerer
(74) Attorney, Agent, or Firm—Mark T. Kresnak; Elizabeth M. Barnes; Ginger R. Dreger, Esq.

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

15 Claims, 330 Drawing Sheets

FIGURE 1

```
CGGACGCGTGGGTGCGAGGCGAAGGTGACCGGGGACCGAGCATTTCAGATCTGCTCGGTAGA
CCTGGTGCACCACCACCATGTTGGCTGCAAGGCTGGTGTGTCTCCGGACACTACCTTCTAGG
GTTTTCCACCCAGCTTTCACCAAGGCCTCCCCTGTTGTGAAGAATTCCATCACGAAGAATCA
ATGGCTGTTAACACCTAGCAGGGAATATGCCACCAAAACAAGAATTGGGATCCGGCGTGGGA
GAACTGGCCAAGAACTCAAAGAGGCAGCATTGGAACCATCGATGGAAAAAATATTTAAAATT
GATCAGATGGGAAGATGGTTTGTTGCTGGAGGGGCTGCTGTTGGTCTTGGAGCATTGTGCTA
CTATGGCTTGGGACTGTCTAATGAGATTGGAGCTATTGAAAAGGCTGTAATTTGGCCTCAGT
ATGTCAAGGATAGAATTCATTCCACCTATATGTACTTAGCAGGGAGTATTGGTTTAACAGCT
TTGTCTGCCATAGCAATCAGCAGAACGCCTGTTCTCATGAACTTCATGATGAGAGGCTCTTG
GGTGACAATTGGTGTGACCTTTGCAGCCATGGTTGGAGCTGGAATGCTGGTACGATCAATAC
CATATGACCAGAGCCCAGGCCCAAAGCATCTTGCTTGGTTGCTACATTCTGGTGTGATGGGT
GCAGTCGTGGCTCCTCTGACAATATTAGGGGGTCCTCTTCTCATCAGAGCTGCATGGTACAC
AGCTGGCATTGTGGGAGGCCTCTCCACTGTGGCCATGTGTGCGCCCAGTGAAAAGTTTCTGA
ACATGGGTGCACCCCTGGGAGTGGGCCTGGGTCTCGTCTTTGTGTCCTCATTGGGATCTATG
TTTCTTCCACCTACCACCGTGGCTGGTGCCACTCTTTACTCAGTGGCAATGTACGGTGGATT
AGTTCTTTTCAGCATGTTCCTTCTGTATGATACCCAGAAAGTAATCAAGCGTGCAGAAGTAT
CACCAATGTATGGAGTTCAAAAATATGATCCCATTAACTCGATGCTGAGTATCTACATGGAT
ACATTAAATATATTTATGCGAGTTGCAACTATGCTGGCAACTGGAGGCAACAGAAAGAAATG
AAGTGACTCAGCTTCTGGCTTCTCTGCTACATCAAATATCTTGTTTAATGGGGCAGATATGC
ATTAAATAGTTTGTACAAGCAGCTTTCGTTGAAGTTTAGAAGATAAGAAACATGTCATCATA
TTTAAATGTTCCGGTAATGTGATGCCTCAGGTCTGCCTTTTTTTCTGGAGAATAAATGCAGT
AATCCTCTCCCAAATAAGCACACACATTTTCAATTCTCATGTTTGAGTGATTTTAAAATGTT
TTGGTGAATGTGAAAACTAAAGTTTGTGTCATGAGAATGTAAGTCTTTTTTCTACTTTAAAA
TTTAGTAGGTTCACTGAGTAACTAAAATTTAGCAAACCTGTGTTTGCATATTTTTTGGAGT
GCAGAATATTGTAATTAATGTCATAAGTGATTTGGAGCTTTGGTAAAGGGACCAGAGAGAAG
GAGTCACCTGCAGTCTTTTGTTTTTTTAAATACTTAGAACTTAGCACTTGTGTTATTGATTA
GTGAGGAGCCAGTAAGAAACATCTGGGTATTTGGAAACAAGTGGTCATTGTTACATTCATTT
GCTGAACTTAACAAAACTGTTCATCCTGAAACAGGCACAGGTGATGCATTCTCCTGCTGTTG
CTTCTCAGTGCTCTCTTTCCAATATAGATGTGGTCATGTTTGACTTGTACAGAATGTTAATC
ATACAGAGAATCCTTGATGGAATTATATATGTGTGTTTTACTTTTGAATGTTACAAAAGGAA
ATAACTTTAAAACTATTCTCAAGAGAAAATATTCAAAGCATGAAATATGTTGCTTTTTCCAG
AATACAAACAGTATACTCATG
```

FIGURE 2

MLAARLVCLRTLPSRVFHPAFTKASPVVKNSITKNQWLLTPSREYATKTRIGIRRGRTGQEL
KEAALEPSMEKIFKIDQMGRWFVAGGAAVGLGALCYYGLGLSNEIGAIEKAVIWPQYVKDRI
HSTYMYLAGSIGLTALSAIAISRTPVLMNFMMRGSWVTIGVTFAAMVGAGMLVRSIPYDQSP
GPKHLAWLLHSGVMGAVVAPLTILGGPLLIRAAWYTAGIVGGLSTVAMCAPSEKFLNMGAPL
GVGLGLVFVSSLGSMFLPPTTVAGATLYSVAMYGGLVLFSMFLLYDTQKVIKRAEVSPMYGV
QKYDPINSMLSIYMDTLNIFMRVATMLATGGNRKK

FIGURE 3

```
GAAGGCTGCCTCGCTGGTCCGAATTCGGTGGCGCCACGTCCGCCCGTCTCCGCCTTCTGCAT
CGCGGCTTCGGCGGCTTCCACCTAGACACCTAACAGTCGCGGAGCCGGCCGCGTCGTGAGGG
GGTCGGCACGGGGAGTCGGGCGGTCTTGTGCATCTTGGCTACCTGTGGGTCGAAGATGTCGG
ACATCGGAGACTGGTTCAGGAGCATCCCGGCGATCACGCGCTATTGGTTCGCCGCCACCGTC
GCCGTGCCCTTGGTCGGCAAACTCGGCCTCATCAGCCCGGCCTACCTCTTCCTCTGGCCCGA
AGCCTTCCTTTATCGCTTTCAGATTTGGAGGCCAATCACTGCCACCTTTTATTTCCCTGTGG
GTCCAGGAACTGGATTTCTTTATTTGGTCAATTTATATTTCTTATATCAGTATTCTACGCGA
CTTGAAACAGGAGCTTTTGATGGGAGGCCAGCAGACTATTTATTCATGCTCCTCTTTAACTG
GATTTGCATCGTGATTACTGGCTTAGCAATGGATATGCAGTTGCTGATGATTCCTCTGATCA
TGTCAGTACTTTATGTCTGGGCCCAGCTGAACAGAGACATGATTGTATCATTTTGGTTTGGA
ACACGATTTAAGGCCTGCTATTTACCCTGGGTTATCCTTGGATTCAACTATATCATCGGAGG
CTCGGTAATCAATGAGCTTATTGGAAATCTGGTTGGACATCTTTATTTTTTCCTAATGTTCA
GATACCCAATGGACTTGGGAGGAAGAAATTTTCTATCCACACCTCAGTTTTTGTACCGCTGG
CTGCCCAGTAGGAGAGGAGGAGTATCAGGATTTGGTGTGCCCCCTGCTAGCATGAGGCGAGC
TGCTGATCAGAATGGCGGAGGCGGGAGACACAACTGGGCCAGGGCTTTCGACTTGGAGACC
AGTGAAGGGGCGGCCTCGGGCAGCCGCTCCTCTCAAGCCACATTTCCTCCCAGTGCTGGGTG
CACTTAACAACTGCGTTCTGGCTAACACTGTTGGACCTGACCCACACTGAATGTAGTCTTTC
AGTACGAGACAAAGTTTCTTAAATCCCGAAGAAAAATATAAGTGTTCCACAAGTTTCACGAT
TCTCATTCAAGTCCTTACTGCTGTGAAGAACAAATACCAACTGTGCAAATTGCAAAACTGAC
TACATTTTTTGGTGTCTTCTCTTCTCCCCTTTCCGTCTGAATAATGGGTTTTAGCGGGTCCT
AATCTGCTGGCATTGAGCTGGGGCTGGGTCACCAAACCCTTCCCAAAAGGACCTTATCTCTT
TCTTGCACACATGCCTCTCTCCCACTTTTCCCAACCCCCACATTTGCAACTAGAAAAAGTTG
CCCATAAAATTGCTCTGCCCTTGACAGGTTCTGTTATTTATTGACTTTTGCCAAGGCTGGTC
ACAACAATCATATTCACGTTATTTTCCCCTTTTGGTGGCAGAACTGTTACCAATAGGGGGAG
AAGACAGCCACGGATGAAGCGTTTCTCAGCTTTTGGAATTGCTTCGACTGACATCCGTTGTT
AACCGTTTGCCACTCTTCAGATATTTTTTATAAAAAAAGTACCACTGAGTTCATGAGGGCCA
CAGATTGGTTATTAATGAGATACGAGGGTTGGTGCTGGGTGTTTGTTTCCTGAGCTAAGTGA
TCAAGACTGTAGTGGAGTTGCAGCTAACATGGGTTAGGTTTAAACCATGGGGGATGCACCCC
TTTGCGTTTCATATGTAGCCCTACTGGCTTTGTGTAGCTGGAGTAGTTGGGTTGCTTTGTGT
TAGGAGGATCCAGATCATGTTGGCTACAGGGAGATGCTCTCTTTGAGAGGTCCTGGGCATTG
ATTCCCATTTCAATCTCATTCTGGATATGTGTTCATTGAGTAAAGGAGGAGAGACCCTCATA
CGCTATTTAAATGTCACTTTTTTGCCTATCCCCGTTTTTGGTCATGTTTCAATTAATTGT
GAGGAAGGCGCAGCTCCTCTCTGCACGTAGATCATTTTTTAAAGCTAATGTAAGCACATCTA
AGGGAATAACATGATTTAAGGTTGAAATGGCTTTAGAATCATTTGGGTTTGAGGGTGTGTTA
TTTTGAGTCATGAATGTACAAGCTCTGTGAATCAGACCAGCTTAAATACCCACACCTTTTTT
TCGTAGGTGGGCTTTTCCTATCAGAGCTTGGCTCATAACCAAATAAAGTTTTTTGAAGGCCA
TGGCTTTTCACACAGTTATTTTATTTTATGACGTTATCTGAAAGCAGACTGTTAGGAGCAGT
ATTGAGTGGCTGTCACACTTTGAGGCAACTAAAAAGGCTTCAAACGTTTTGATCAGTTTCTT
TTCAGGAAACATTGTGCTCTAACAGTATGACTATTCTTTCCCCCACTCTTAAACAGTGTGAT
GTGTGTTATCCTAGGAAATGAGAGTTGGCAAACAACTTCTCATTTTGAATAGAGTTTGTGTG
TACTTCTCCATATTTAATTTATATGATAAAATAGGTGGGGAGAGTCTGAACCTTAACTGTCA
TGTTTTGTTGTTCATCTGTGGCCACAATAAAGTTTACTTGTAAAATTTTAGAGGCCATTACT
CCAATTATGTTGCACGTACACTCATTGTACAGGCGTGGAGACTCATTGTATGTATAAGAATA
TTTCTGACAGTGAGTGACCCGGAGTCTCTGGTGTACCCTCTTACCAGTCAGCTGCCTGCGAG
CAGTCATTTTTTCCTAAAGGTTTACAAGTATTTAGAACTTTTCAGTTCAGGGCAAAATGTTC
ATGAAGTTATTCCTCTTAAACATGGTTAGGAAGCTGATGACGTTATTGATTTTGTCTGGATT
ATGTTTCTGGAATAATTTTACCAAAACAAGCTATTTGAGTTTTGACTTGACAAGGCAAAACA
TGACAGTGGATTCTCTTTACAAATGGAAAAAAAAATCCTTATTTTGTATAAAGGACTTCCC
TTTTTGTAAACTAATCCTTTTTATTGGTAAAAATTGTAAATTAAAATGTGCAACTTG
```

FIGURE 4

MSDIGDWFRSIPAITRYWFAATVAVPLVGKLGLISPAYLFLWPEAFLYRFQIWRPITATFYF
PVGPGTGFLYLVNLYFLYQYSTRLETGAFDGRPADYLFMLLFNWICIVITGLAMDMQLLMIP
LIMSVLYVWAQLNRDMIVSFWFGTRFKACYLPWVILGFNYIIGGSVINELIGNLVGHLYFFL
MFRYPMDLGGRNFLSTPQFLYRWLPSRRGGVSGFGVPPASMRRAADQNGGGGRHNWGQGFRL
GDQ

Transmembrane domain:

amino acids 98-116, 152-172

N-myristoylation site.

amino acids 89-95, 168-174, 176-182, 215-221, 221-227, 237-243

Glycosaminoglycan attachment site.

amino acids 218-222

FIGURE 5

GGGGCCGCGGTCTAGGGCGGCTACGTGTGTTGCCATAGCGACCATTTTGCATTAACTGGTTG
GTAGCTTCTATCCTGGGGGCTGAGCGACTGCGGGCCAGCTCTTCCCCTACTCCCTCTCGGCT
CCTTGTGGCCCAAAGGCCTAACCGGGGTCCGGCGGTCTGGCCTAGGGATCTTCCCCGTTGCC
CCTTTGGGGCGGGATGGCTGCGGAAGAAGAAGACGAGGTGGAGTGGGTAGTGGAGAGCATCG
CGGGGTTCCTGCGAGGCCCAGACTGGTCCATCCCCATCTTGGACTTTGTGGAACAGAAATGT
GAAGTTAACTGCAAAGGAGGGCATGTGATAACTCCAGGAAGCCCAGAGCCGGTGATTTTGGT
GGCCTGTGTTCCCCTTGTTTTTGATGATGAAGAAGAAAGCAAATTGACCTATACAGAGATTC
ATCAGGAATACAAAGAACTAGTTGAAAAGCTGTTAGAAGGTTACCTCAAAGAAATTGGAATT
AATGAAGATCAATTTCAAGAAGCATGCACTTCTCCTCTTGCAAAGACCCATACATCACAGGC
CATTTTGCAACCTGTGTTGGCAGCAGAAGATTTTACTATCTTTAAAGCAATGATGGTCCAGA
AAAACATTGAAATGCAGCTGCAAGCCATTCGAATAATTCAAGAGAGAAATGGTGTATTACCT
GACTGCTTAACCGATGGCTCTGATGTGGTCAGTGACCTTGAACACGAAGAGATGAAAATCCT
GAGGGAAGTTCTTAGAAAATCAAAAGAGGAATATGACCAGGAAGAAGAAAGGAAGAGGAAAA
AACAGTTATCAGAGGCTAAAACAGAAGAGCCCACAGTGCATTCCAGTGAAGCTGCAATAATG
AATAATTCCCAAGGGGATGGTGAACATTTTGCACACCCACCCTCAGAAGTTAAAATGCATTT
TGCTAATCAGTCAATAGAACCTTTGGGAAGAAAAGTGGAAAGGTCTGAAACTTCCTCCCTCC
CACAAAAAGGCCTGAAGATTCCTGGCTTAGAGCATGCGAGCATTGAAGGACCAATAGCAAAC
TTATCAGTACTTGGAACAGAAGAACTTCGGCAACGAGAACACTATCTCAAGCAGAAGAGAGA
TAAGTTGATGTCCATGAGAAAGGATATGAGGACTAAACAGATACAAAATATGGAGCAGAAAG
GAAAACCCACTGGGGAGGTAGAGGAAATGACAGAGAAACCAGAAATGACAGCAGAGGAGAAG
CAAACATTACTAAAGAGGAGATTGCTTGCAGAGAAACTCAAAGAAGAAGTTATTAATAAGTA
ATAATTAAGAACAATTTAACAAAATGGAAGTTCAAATTGTCTTAAAAATAAATTATTTAGTC
CTTACACTG

FIGURE 6

MAAEEEDEVEWVVESIAGFLRGPDWSIPILDFVEQKCEVNCKGGHVITPGSPEPVILVACVP
LVFDDEEESKLTYTEIHQEYKELVEKLLEGYLKEIGINEDQFQEACTSPLAKTHTSQAILQP
VLAAEDFTIFKAMMVQKNIEMQLQAIRIIQERNGVLPDCLTDGSDVVSDLEHEEMKILREVL
RKSKEEYDQEEERKRKKQLSEAKTEEPTVHSSEAAIMNNSQGDGEHFAHPPSEVKMHFANQS
IEPLGRKVERSETSSLPQKGLKIPGLEHASIEGPIANLSVLGTEELRQREHYLKQKRDKLMS
MRKDMRTKQIQNMEQKGKPTGEVEEMTEKPEMTAEEKQTLLKRRLLAEKLKEEVINK

N-glycosylation sites.

amino acids 224-228, 246-250, 285-289

N-myristoylation site.

amino acids 273-279

Amidation site.

amino acids 252-256

Cytosolic fatty-acid binding proteins.

amino acids 78-108

FIGURE 7

```
GGGCACAGCACATGTGAAGTTTTTGATGATGAAGAAGAAAGCAAATTGACCTATACAGAGAT
TCATCAGGAATACAAAGAACTAGTTGAAAAGCTGTTAGAAGGTTACCTCAAAGAAATTGGAA
TTAATGAAGATCAATTTCAAGAAGCATGCACTTCTCCTCTTGCAAAGACCCATACATCACAG
GCCATTTTTGCAACCTGTGTTGGCAGCAGAAGATTTTACTATCTTTAAAGCAATGATGGTCC
AGAAAAACATTGAAATGCAGCTGCAAGCCATTCGAATAATTCAAGAGAGAAATGGTGTATTA
CCTGACTGCTTAACCGATGGCTCTGATGTGGTCAGTGACCTTGAACACGAAGAGATGAAAAT
CCTGAGGGAAGTTCTTAGAAAATCAAAAGAGGAATATGACCAGGAA
```

FIGURE 8

```
GCGTGGTTTTTGTTCTGCAATAGGCGGCTTAGAGGGAGGGGCTTTTTCGCCTATACCTACTG
TAGCTTCTCCACGTATGGACCCTAAAGGCTACTGCTGCTACTACGGGGCTAGACAGTTACTG
TCTCAGCTCTAGGATGTGCGTTCTTCCACTAGAAGCTCTTCTGAGGGAGGTAATTAAAAAAC
AGTGGAATGGAAAAACAGTGCTGTAGTCATCCTGTAATATGCTCCTTGTCAACAATGTATAC
ATTCCTGCTAGGTGCCATATTCATTGCTTTAAGCTCAAGTCGCATCTTACTAGTGAAGTATT
CTGCCAATGAAGAAAACAAGTATGATTATCTTCCAACTACTGTAATGTGTGCTCAGAACTG
GTGAAGCTAGTTTTCTGTGTGCTTGTGTCATTCTGTGTTATAAAGAAGATCATCAAAGTAG
AAATTTGAAATATGCTTCCTGGAAGGAATTCTCTGATTTCATGAAGTGGTCCATTCCTGCCT
TTCTTTATTTCCTGGATAACTTGATTGTCTTCTATGTCCTGTCCTATCTTCAACCAGCCATG
GCTGTTATCTTCTCAAATTTTAGCATTATAACAACAGCTCTTCTATTCAGGATAGTGCTGAA
GAGGCGTCTAAACTGGATCCAGTGGGCTTCCCTCCTGACTTTATTTTTGTCTATTGTGGCCT
TGACTGCCGGGACTAAAACTTTACAGCACAACTTGGCAGGACGTGGATTTCATCACGATGCC
TTTTTCAGCCCTTCCAATTCCTGCCTTCTTTTCAGAAGTGAGTGTCCCAGAAAAGACAATTG
TACAGCAAAGGAATGGACTTTTCCTGAAGCTAAATGGAACACCACAGCCAGAGTTTTCAGTC
ACATCCGTCTTGGCATGGGCCATGTTCTTATTATAGTCCAGTGTTTTATTTCTTCAATGGCT
AATATCTATAATGAAAAGATACTGAAGGAGGGGAACCAGCTCACTGAAAGCATCTTCATACA
GAACAGCAAACTCTATTTCTTTGGCATTCTGTTTAATGGGCTGACTCTGGGCCTTCAGAGGA
GTAACCGTGATCAGATTAAGAACTGTGGATTTTTTTATGGCCACAGTGCATTTTCAGTAGCC
CTTATTTTTGTAACTGCATTCCAGGGCCTTTCAGTGGCTTTCATTCTGAAGTTCCTGGATAA
CATGTTCCATGTCTTGATGGCCCAGGTTACCACTGTCATTATCACAACAGTGTCTGTCCTGG
TCTTTGACTTCAGGCCCTCCCTGGAATTTTTCTTGGAAGCCCCATCAGTCCTTCTCTCTATA
TTTATTTATAATGCCAGCAAGCCTCAAGTTCCGGAATACGCACCTAGGCAAGAAAGGATCCG
AGATCTAAGTGGCAATCTTTGGGAGCGTTCCAGTGGGGATGGAGAAGAACTAGAAAGACTTA
CCAAACCCAAGAGTGATGAGTCAGATGAAGATACTTTCTAACTGGTACCCACATAGTTTGCA
GCTCTCTTGAACCTTATTTTCACATTTTCAGTGTTTGTAATATTTATCTTTTCACTTTGATA
AACCAGAAATGTTTCTAAATCCTAATATTCTTTGCATATATCTAGCTACTCCCTAAATGGTT
CCATCCAAGGCTTAGAGTACCCAAAGGCTAAGAAATTCTAAAGAACTGATACAGGAGTAACA
ATATGAAGAATTCATTAATATCTCAGTACTTGATAAATCAGAAAGTTATATGTGCAGATTAT
TTTCCTTGGCCTTCAAGCTTCCAAAAAACTTGTAATAATCATGTTAGCTATAGCTTGTATAT
ACACATAGAGATCAATTTGCCAAATATTCACAATCATGTAGTTCTAGTTTACATGCCAAAGT
CTTCCCTTTTTAACATTATAAAAGCTAGGTTGTCTCTTGAATTTTGAGGCCCTAGAGATAGT
CATTTTGCAAGTAAAGAGCAACGGGACCCTTTCTAAAAACGTTGGTTGAAGGACCTAAATAC
CTGGCCATACCATAGATTTGGGATGATGTAGTCTGTGCTAAATATTTTGCTGAAGAAGCAGT
TTCTCAGACACAACATCTCAGAATTTTAATTTTTAGAAATTCATGGGAAATTGGATTTTTGT
AATAATCTTTTGATGTTTTAAACATTGGTTCCCTAGTCACCATAGTTACCACTTGTATTTTA
AGTCATTTAAACAAGCCACGGTGGGGCTTTTTTCTCCTCAGTTTGAGGAGAAAAATCTTGAT
GTCATTACTCCTGAATTATTACATTTTGGAGAATAAGAGGGCATTTATTTTATTAGTTACT
AATTCAAGCTGTGACTATTGTATATCTTTCCAAGAGTTGAAATGCTGGCTTCAGAATCATAC
CAGATTGTCAGTGAAGCTGATGCCTAGGAACTTTTAAAGGGATCCTTTCAAAAGGATCACTT
AGCAAACACATGTTGACTTTAACTGATGTATGAATATTAATACTCTAAAAATAGAAAGACC
AGTAATATATAAGTCACTTTACAGTGCTACTTCACACTTAAAAGTGCATGGTATTTTTCATG
GTATTTTGCATGCAGCCAGTTAACTCTCGTAGATAGAGAAGTCAGGTGATAGATGATATTAA
AAATTAGCAAACAAAAGTGACTTGCTCAGGGTCATGCAGCTGGTGATGATAGAAGAGTGGG
CTTTAACTGGCAGGCCTGTATGTTTACAGACTACCATACTGTAAATATGAGCTTTATGGTGT
CATTCTCAGAAACTTATACATTTCTGCTCTCCTTTCTCCTAAGTTTCATGCAGATGAATATA
AGGTAATATACTATTATATAATTCATTTGTGATATCCACAATAATATGACTGGCAAGAATTG
GTGGAAATTTGTAATTAAAATAATTATTAAACCT
```

FIGURE 9

MEKQCCSHPVICSLSTMYTFLLGAIFIALSSSRILLVKYSANEENKYDYLPTTVNVCSELVK
LVFCVLVSFCVIKKDHQSRNLKYASWKEFSDFMKWSIPAFLYFLDNLIVFYVLSYLQPAMAV
IFSNFSIITTALLFRIVLKRRLNWIQWASLLTLFLSIVALTAGTKTLQHNLAGRGFHHDAFF
SPSNSCLLFRSECPRKDNCTAKEWTFPEAKWNTTARVFSHIRLGMGHVLIIVQCFISSMANI
YNEKILKEGNQLTESIFIQNSKLYFFGILFNGLTLGLQRSNRDQIKNCGFFYGHSAFSVALI
FVTAFQGLSVAFILKFLDNMFHVLMAQVTTVIITTVSVLVFDFRPSLEFFLEAPSVLLSIFI
YNASKPQVPEYAPRQERIRDLSGNLWERSSGDGEELERLTKPKSDESDEDTF

Transmembrane domains:

amino acids 16-36 (type II), 50-74, 147-168, 229-250, 271-293, 298-318, 328-368

N-glycosylation sites.

amino acids 128-132, 204-208, 218-222, 374-378

Glycosaminoglycan attachment site.

amino acids 402-406

N-myristoylation sites.

amino acids 257-263, 275-281, 280-286, 284-290, 317-323

FIGURE 10

```
CGTGCCTGCGCAATGGGTGTCGGGTCCGCTTTTTCCCAATCCGGACGTAATCGTGGTTTTG
TTCTGCAATAGGCGGCTTAGAGGGAGGGGCTTTTTCGCCTATACCTACTGTAGCTTCTCCAC
GTATGGACCCTAAAGGCTACTGCTGCTACTACGGGGCTAGACAGTTACTGTCTCAGCTCTAG
GATGTGCGTTCTTCCACTAGAAGCTCTTCTGAGGGAGGTAATTAAAAAACAGTGGAATGGAA
AAACAGTGCTGTAGTCATCCTGTAATATGCTCCTTGTCAACAATGTATACATTCCTGCTAGG
TGCCATATTCATTGCTTTAAGCTCAAGTCGCATCTTACTAGTGAAGTATTCTGCCAATGAAG
AAAACAAGTATGATTATCTTCCAACTACTGTGAATGTGTGCTCAGAACTGGTGAAGCTAGTT
TTCTGTGTGCTTGTGTCATTCTGTGTTATAAAGAAAGATCATCAAAGTAGAAATTTGAAATA
TGCTTCCTGGAAGGAATTCTCTGATTTCATGAAGTGGTCCATTCCTGCCTTTCTTTATTTCC
TGGATAACTTGATTGTCTTCTATGTCCTGTCCTATCTTCAACCAGCCATGGCTGTTATCTTC
TCAAATTTTAGCATTATAACAACAGCTCTTCTATTCAGGATAGTGCTGAAGAGGCGTCTAAA
CTGGATCCAGTGGGCTTCCCTCCTGACTTTATTTTTGTCTATTGTGGCCTTGACTGCCGGGA
CTAAAACTTTA
```

FIGURE 11

```
CGGACGCGTGGGCGGACGCGTGGGCGGACGCGTGGGGCCGGCTTGGCTAGCGCGCGGCGGCC
GTGGCTAAGGCTGCTACGAAGCGAGCTTGGGAGGAGCAGCGGCCTGCGGGGCAGAGGAGCAT
CCCGTCTACCAGGTCCCAAGCGGCGTGGCCCGCGGGTCATGGCCAAAGGAGAAGGCGCCGAG
AGCGGCTCCGCGGCGGGGCTGCTACCCACCAGCATCCTCCAAAGCACTGAACGCCCGGCCCA
GGTGAAGAAGAACCGAAAAAGAAGAAACAACAGTTGTCTGTTTGCAACAAGCTTTGCTATG
CACTTGGGGGAGCCCCCTACCAGGTGACGGGCTGTGCCCTGGGTTTCTTCCTTCAGATCTAC
CTATTGGATGTGGCTCAGGTGGGCCCTTTCTCTGCCTCCATCATCCTGTTTGTGGGCCGAGC
CTGGGATGCCATCACAGACCCCTGGTGGGCCTCTGCATCAGCAAATCCCCCTGGACCTGCC
TGGGTCGCCTTATGCCCTGGATCATCTTCTCCACGCCCTGGCCGTCATTGCCTACTTCCTC
ATCTGGTTCGTGCCCGACTTCCCACACGGCCAGACCTATTGGTACCTGCTTTTCTATTGCCT
CTTTGAAACAATGGTCACGTGTTTCCATGTTCCCTACTCGGCTCTCACCATGTTCATCAGCA
ACCGAGCAGACTGAGCGGGATTCTGCCACCGCCATCGGATGACTGTGGAAGTGCTGGGCAC
AGTGCTGGGCACGGCGATCCAGGGACAAATCGTGGGCCAAGCAGACACGCCTTGTTTCCAGG
ACTTCAATAGCTCTACAGTAGCTTCACAAAGTGCCAACCATACACATGGCACCACTTCACAC
AGGGAAACGCAAAAGGCATACCTGCTGGCAGCGGGGGTCATTGTCTGTATCTATATAATCTG
TGCTGTCATCCTGATCCTGGGCGTGCGGGAGCAGAGAGAACCCTATGAAGCCCAGCAGTCTG
AGCCAATCGCCTACTTCCGGGGCCTACGGCTGGTCATGAGCCACGGCCCATACATCAAACTT
ATTACTGGCTTCCTCTTCACCTCCTTGGCTTTCATGCTGGTGGAGGGGAACTTTGTCTTGTT
TTGCACCTACACCTTGGGCTTCCGCAATGAATTCCAGAATCTACTCCTGGCCATCATGCTCT
CGGCCACTTTAACCATTCCCATCTGGCAGTGGTTCTTGACCCGGTTTGGCAAGAAGACAGCT
GTATATGTTGGGATCTCATCAGCAGTGCCATTTCTCATCTTGGTGGCCCTCATGGAGAGTAA
CCTCATCATTACATATGCGGTAGCTGTGGCAGCTGGCATCAGTGTGGCAGCTGCCTTCTTAC
TACCCTGGTCCATGCTGCCTGATGTCATTGACGACTTCCATCTGAAGCAGCCCCACTTCCAT
GGAACCGAGCCCATCTTCTTCTCCTTCTATGTCTTCTTCACCAAGTTTGCCTCTGGAGTGTC
ACTGGGCATTTCTACCCTCAGTCTGGACTTTGCAGGGTACCAGACCCGTGGCTGCTCGCAGC
CGGAACGTGTCAAGTTTACACTGAACATGCTCGTGACCATGGCTCCCATAGTTCTCATCCTG
CTGGGCCTGCTGCTCTTCAAAATGTACCCCATTGATGAGGAGAGGCGGCGGCAGAATAAGAA
GGCCCTGCAGGCACTGAGGGACGAGGCCAGCAGCTCTGGCTGCTCAGAAACAGACTCCACAG
AGCTGGCTAGCATCCTCTAGGGCCCGCCACGTTGCCCGAAGCCACCATGCAGAAGGCCACAG
AAGGGATCAGGACCTGTCTGCCGGCTTGCTGAGCAGCTGGACTGCAGGTGCTAGGAAGGGAA
CTGAAGACTCAAGGAGGTGGCCCAGGACACTTGCTGTGCTCACTGTGGGCCGGCTGCTCTG
TGGCCTCCTGCCTCCCCTCTGCCTGCCTGTGGGCCAAGCCCTGGGCTGCCACTGTGAATA
TGCCAAGGACTGATCGGGCCTAGCCCGGAACACTAATGTAGAAACCTTTTTTTTACAGAGCC
TAATTAATAACTTAATGACTGTGTACATAGCAATGTGTGTGTATGTATATGTCTGTGAGCTA
TTAATGTTATTAATTTTCATAAAAGCTGGAAAGC
```

FIGURE 12

MWLRWALSLPPSSCLWAEPGMPSQTPWWASASANPPGPAWVALCPGSSSPRPWPSLPTSSSG
SCPTSHTARPIGTCFSIASLKQWSRVSMFPTRLSPCSSATEQTERDSATAYRMTVEVLGTVL
GTAIQGQIVGQADTPCFQDFNSSTVASQSANHTHGTTSHRETQKAYLLAAGVIVCIYIICAV
ILILGVREQREPYEAQQSEPIAYFRGLRLVMSHGPYIKLITGFLFTSLAFMLVEGNFVLFCT
YTLGFRNEFQNLLLAIMLSATLTIPIWQWFLTRFGKKTAVYVGISSAVPFLILVALMESNLI
ITYAVAVAAGISVAAAFLLPWSMLPDVIDDFHLKQPHFHGTEPIFFSFYVFFTKFASGVSLG
ISTLSLDFAGYQTRGCSQPERVKFTLNMLVTMAPIVLILLGLLLFKMYPIDEERRRQNKKAL
QALRDEASSSGCSETDSTELASIL

FIGURE 13

```
GGGAAACGCAAAAGGCATACCTGCTGGCAGCGGGGGTCATTGTCTGTATCTATATAATCTGT
GCTGTCATCCTGATCCTGGGCGTGCGGGAGCAGAGAGAACCCTATGAAGCCCAGCAGTCTGA
GCCAATCGCCTACTTCCGGGGCCTACGGCTGGTCATGAGCCACGGCCCATACATCAAACTTA
TTACTGGCTTCCTCTTCACCTCCTTGGCTTTCATGCTGGTGGAGGGGAACTTTGTCTTGTTT
TGCACCTACACCTTGGGCTTCCGCAATGAATTCCAGAATCTACTCCTGGCCATCATGCTCTC
GGCCACTTTAACCATTCCCATCTGGCAGTGGTTCTTGACCCGGTTTGGCAAGAAGACAGCTG
TATATGTTGGGATCTCATCAGCAGTGCCATTTCTCATCTTGGTGGCCCTCATGGAGAGTAAC
CTCATCATTACATATGCGGTAGCTGTGGCAGCTGGCATCAGTGTGGCAGCTGCCTTCTTACT
ACCCTGGTCCATGCTGCCTGATGTCATTGACGACTTCCATCTGAAGCAGCCCCACTTCCATG
GAACCGAGCCCAT
```

FIGURE 14

GGGGCTTCGGCGCCAGCGGCCAGCGCTAGTCGGTCTGGTAAGGATTTACAAAAGGTGCAGGT
ATGAGCAGGTCTGAAGACTAACATTTTGTGAAGTTGTAAAACAGAAAACCTGTTAGAAATGT
GGTGGTTTCAGCAAGGCCTCAGTTTCCTTCCTTCAGCCCTTGTAATTTGGACATCTGCTGCT
TTCATATTTTCATACATTACTGCAGTAACACTCCACCATATAGACCCGGCTTTACCTTATAT
CAGTGACACTGGTACAGTAGCTCCAGAAAAATGCTTATTTGGGGCAATGCTAAATATTGCGG
CAGTTTTATGCATTGCTACCATTTATGTTCGTTATAAGCAAGTTCATGCTCTGAGTCCTGAA
GAGAACGTTATCATCAAATTAAACAAGGCTGGCCTTGTACTTGGAATACTGAGTTGTTTAGG
ACTTTCTATTGTGGCAAACTTCCAGAAAACAACCCTTTTTGCTGCACATGTAAGTGGAGCTG
TGCTTACCTTTGGTATGGGCTCATTATATATGTTTGTTCAGACCATCCTTTCCTACCAAATG
CAGCCCAAAATCCATGGCAAACAAGTCTTCTGGATCAGACTGTTGTTGGTTATCTGGTGTGG
AGTAAGTGCACTTAGCATGCTGACTTGCTCATCAGTTTTGCACAGTGGCAATTTTGGGACTG
ATTTAGAACAGAAACTCCATTGGAACCCCGAGGACAAAGGTTATGTGCTTCACATGATCACT
ACTGCAGCAGAATGGTCTATGTCATTTTCCTTCTTTGGTTTTTTCCTGACTTACATTCGTGA
TTTTCAGAAAATTTCTTTACGGGTGGAAGCCAATTTACATGGATTAACCCTCTATGACACTG
CACCTTGCCCTATTAACAATGAACGAACACGGCTACTTTCCAGAGATATTTGATGAAAGGAT
AAAATATTTCTGTAATGATTATGATTCTCAGGGATTGGGGAAAGGTTCACAGAAGTTGCTTA
TTCTTCTCTGAAATTTTCAACCACTTAATCAAGGCTGACAGTAACACTGATGAATGCTGATA
ATCAGGAAACATGAAAGAAGCCATTTGATAGATTATTCTAAAGGATATCATCAAGAAGACTA
TTAAAAACACCTATGCCTATACTTTTTTATCTCAGAAAATAAAGTCAAAAGACTATG

FIGURE 15

```
MWWFQQGLSFLPSALVIWTSAAFIFSYITAVTLHHIDPALPYISDTGTVAPEKCLFGAMLNI
AAVLCIATIYVRYKQVHALSPEENVIIKLNKAGLVLGILSCLGLSIVANFQKTTLFAAHVSG
AVLTFGMGSLYMFVQTILSYQMQPKIHGKQVFWIRLLLVIWCGVSALSMLTCSSVLHSGNFG
TDLEQKLHWNPEDKGYVLHMITTAAEWSMSFSFFGFFLTYIRDFQKISLRVEANLHGLTLYD
TAPCPINNERTRLLSRDI
```

FIGURE 16

CGGACGCTTGGGCNGCGCCAGCGGCCAGCGCTAGTCGGTCTGGTAAGTGCCTGATGCCGAGT
TCCGTCTCTCGGGTCTTTTCCTGGTCCCAGGCAAAGCGGAGCGGAGATCCTCAAACGGCCTA
GTGCTTCGCGCTTCCGGAGAAAATCAGCGGTCTAATTAATTCCTCTGGTTTGTTGAAGCAGT
TACCAAGAATCTTCAACCCTTTCCCACAAAAGCTAATTGAGTACACGTTCCTGTTGAGTACA
CGTTCCTGTTGATTTACAAAAGGTGCAGGTATGAGCAGGTCTGAAGACTAACATTTTGTGAA
GTTGTAAAACAGAAAACCTGTTAGAAATGTGGTGGTTTCAGCAAGGCCTCAGTTTCCTTCCT
TCAGCCCTTGTAATTTGGACATCTGCTGCTTTCATATTTTCATACATTACTGCAGTAACACT
CCACCATATAGACCCGGCTTTACCTTATATCAGTGACACTGGTACAGTANC

FIGURE 17

```
CCCACGCGTCCGCCCGCCGCTGCGTCCCGGAGTGCAAGTGAGCTTCTCGGCTGCCCCGCGGG
CCGGGGTGCGGAGCCGACATGCGCCCGCTTCTCGGCCTCCTTCTGGTCTTCGCCGGCTGCAC
CTTCGCCTTGTACTTGCTGTCGACGCGACTGCCCCGCGGGCGGAGACTGGGCTCCACCGAGG
AGGCTGGAGGCAGGTCGCTGTGGTTCCCCTCCGACCTGGCAGAGCTGCGGGAGCTCTCTGAG
GTCCTTCGAGAGTACCGGAAGGAGCACCAGGCCTACGTGTTCCTGCTCTTCTGCGGCGCCTA
CCTCTACAAACAGGGCTTTGCCATCCCCGGCTCCAGCTTCCTGAATGTTTTAGCTGGTGCCT
TGTTTGGGCCATGGCTGGGGCTTCTGCTGTGCTGTGTGTTGACCTCGGTGGGTGCCACATGC
TGCTACCTGCTCTCCAGTATTTTTGGCAAACAGTTGGTGGTGTCCTACTTTCCTGATAAAGT
GGCCCTGCTGCAGAGAAAGGTGGAGGAGAACAGAAACAGCTTGTTTTTTTTCTTATTGTTTT
TGAGACTTTTCCCCATGACACCAAACTGGTTCTTGAACCTCTCGGCCCCAATTCTGAACATT
CCCATCGTGCAGTTCTTCTTCTCAGTTCTTATCGGTTTGATCCCATATAATTTCATCTGTGT
GCAGACAGGGTCCATCCTGTCAACCCTAACCTCTCTGGATGCTCTTTTCTCCTGGGACACTG
TCTTTAAGCTGTTGGCCATTGCCATGGTGGCATTAATTCCTGGAACCCTCATTAAAAAATTT
AGTCAGAAACATCTGCAATTGAATGAAACAAGTACTGCTAATCATATACACAGTAGAAAAGA
CACATGATCTGGATTTTCTGTTTGCCACATCCCTGGACTCAGTTGCTTATTTGTGTAATGGA
TGTGGTCCTCTAAAGCCCCTCATTGTTTTGATTGCCTTCTATAGGTGATGTGGACACTGTG
CATCAATGTGCAGTGTCTTTTCAGAAAGGACACTCTGCTCTTGAAGGTGTATTACATCAGGT
TTTCAAACCAGCCCTGGTGTAGCAGACACTGCAACAGATGCCTCCTAGAAAATGCTGTTTGT
GGCCGGGCGCGGTGGCTCACGCCTGTAATCCCAGCACTTTGGGAGGCCGAGGCCGGTGATTC
ACAAGGTCAGGAGTTCAAGACCAGCCTGGCCAAGATGGTGAAATCCTGTCTCTAATAAAAAT
ACAAAAATTAGCCAGGCGTGGTGGCAGGCACCTGTAATCCCAGCTACTCGGGAGGCTGAGGC
AGGAGAATTGCTTGAACCAAGGTGGCAGAGGTTGCAGTAAGCCAAGATCACACCACTGCACT
CCAGCCTGGGTGATAGAGTGAGACACTGTCTTGAC
```

FIGURE 18

```
MRPLLGLLLVFAGCTFALYLLSTRLPRGRRLGSTEEAGGRSLWFPSDLAELRELSEVLREYR
KEHQAYVFLLFCGAYLYKQGFAIPGSSFLNVLAGALFGPWLGLLLCCVLTSVGATCCYLLSS
IFGKQLVVSYFPDKVALLQRKVEENRNSLFFFLLFLRLFPMTPNWFLNLSAPILNIPIVQFF
FSVLIGLIPYNFICVQTGSILSTLTSLDALFSWDTVFKLLAIAMVALIPGTLIKKFSQKHLQ
LNETSTANHIHSRKDT
```

Important features:

Signal peptide:

amino acids 1-17

Transmembrane domains:

amino acids 101-123, 189-211

N-glycosylation sites.

amino acids 172-176, 250-254 cAMP- and cGMP-dependent protein kinase phosphorylation site.

amino acids 240-244, 261-265

N-myristoylation site.

amino acids 13-19, 104-110, 115-121, 204-210

Amidation site.

amino acids 27-31

Prokaryotic membrane lipoprotein lipid attachment site.

amino acids 4-15

Protein splicing proteins.

amino acids 25-31

Sugar transport proteins.

amino acids 162-172

FIGURE 19

CCGAGGCGGGAGGAGCCCGAGGGGGCGCGAGCCCCGCATGAATCATTGTAGTCAATCATTTT
CCAGTTCTCAGCCGCTCAGTTGTGATCAAGGGACACGTGGTTTCCGAACTGCCAGCTCAGAA
TAGGAAAATAACTTGGGATTTTATATTGGAAGACATGGATCTTGCTGCCAACGAGATCAGCA
TTTATGACAAACTTTCAGAGACTGTTGATTTGGTGAGACAGACCGGCCATCAGTGTGGCATG
TCAGAGAAGGCAATTGAAAATTTATCAGACAGCTGCTGGAAAAGAATGAACCTCAGAGACC
CCCCCCGCAGTATCCTCTCCTTATAGTTGTGTATAAGGTTCTCGCAACCTTGGGATTAATCT
TGCTCACTGCCTACTTTGTGATTCAACCTTTCAGCCCATTAGCACCTGAGCCAGTGCTTTCT
GGAGCTCACACCTGGCGCTCACTCATCCATCACATTAGGCTGATGTCCTTGCCCATTGCCAA
GAAGTACATGTCAGAAAATAAGGGAGTTCCTCTGCATGGGGGTGATGAAGACAGACCCTTTC
CAGACTTTGACCCCTGGTGGACAAACGACTGTGAGCAGAATGAGTCAGAGCCCATTCCTGCC
AACTGCACTGGCTGTGCCCAGAAACACCTGAAGGTGATGCTCCTGGAAGACGCCCCAAGGAA
ATTTGAGAGGCTCCATCCACTGGTGATCAAGACGGGAAAGCCCCTGTTGGAGGAAGAGATTC
AGCATTTTTTGTGCCAGTACCCTGAGGCGACAGAAGGCTTCTCTGAAGGGTTTTTCGCCAAG
TGGTGGCGCTGCTTTCCTGAGCGGTGGTTCCCATTTCCTTATCCATGGAGGAGACCTCTGAA
CAGATCACAAATGTTACGTGAGCTTTTCCTGTTTTCACTCACCTGCCATTTCCAAAAGATG
CCTCTTTAAACAAGTGCTCCTTTCTTCACCCAGAACCTGTTGTGGGAGTAAGATGCATAAG
ATGCCTGACCTATTTATCATTGGCAGCGGTGAGGCCATGTTGCAGCTCATCCCTCCCTTCCA
GTGCCGAAGACATTGTCAGTCTGTGGCCATGCCAATAGAGCCAGGGGATATCGGCTATGTCG
ACACCACCCACTGGAAGGTCTACGTTATAGCCAGAGGGGTCCAGCCTTTGGTCATCTGCGAT
GGAACCGCTTTCTCAGAACTGTAGGAAATAGAACTGTGCACAGGAACAGCTTCCAGAGCCGA
AAACCAGGTTGAAAGGGGAAAAATAAAAACAAAAACGATGAAACTGCAAAAA

FIGURE 20

MDLAANEISIYDKLSETVDLVRQTGHQCGMSEKAIEKFIRQLLEKNEPQRPPPQYPLLIVVY
KVLATLGLILLTAYFVIQPFSPLAPEPVLSGAHTWRSLIHHIRLMSLPIAKKYMSENKGVPL
HGGDEDRPFPDFDPWWTNDCEQNESEPIPANCTGCAQKHLKVMLLEDAPRKFERLHPLVIKT
GKPLLEEEIQHFLCQYPEATEGFSEGFFAKWWRCFPERWFPFPYPWRRPLNRSQMLRELFPV
FTHLPFPKDASLNKCSFLHPEPVVGSKMHKMPDLFIIGSGEAMLQLIPPFQCRRHCQSVAMP
IEPGDIGYVDTTHWKVYVIARGVQPLVICDGTAFSEL

FIGURE 21

```
CCACGGTGTCCGTTCTTCGCCCGGCGGCAGCTGTCCCCGAGGCGGGAGGAGCCCGAGGGGCG
CGAGCCCCGCATGAATCATTGTAGTCAATCATTTTCCAGTTCTCAGCCGTTCAGTTGTGATC
AAGGGACACGTGGTTTCCGAACTGCCAGCTCAGAATAGGAAAATAACTTGGGATTTTATATT
GGAAGACATGGATCTTGCTGCCAACGAGATCAGCATTTATGACAAACTTTCAGAGACTGTTG
ATTTGGTGAGACAGACCGGCCATCAGTGTGGCATGTCAGAGAAGGCAATTGAAAAATTTATC
AGACAGCTGCTGGAAAAGAATGAACCTCAGAGACCCCCCCGCAGTATCCTCTCCTTATAGT
TGTGTATAAGGTTCTCGCAACCTTGGGATTAATCTTGCTCACTGCCTACTTTGTGATTCAAC
CTTTCAGCCCATTAGCACCTGAGCCAGTGCTTTGTGGAGCTCAC
```

FIGURE 22

```
CCCACGCGTCCGCCCACGCGTCCGGCTGAACACCTCTTCTTTGGAGTCAGCCACTGATGAGG
CAGGGTCCCCACTTGCAGCTGCAGCAGCTGCAGCAGCTGCAGAGCGCTGCTCCTGGCTGGTG
CCACTGGTGCGCACGCTGCTAGACCGTGCCTATGAGCCGCTGGGGCTGCAGTGGGGACTGCC
CTCCCTGCCACCCACCAATGGCAGCCCCACCTTCTTTGAAGACTTCCAGGCTTTTTGTGCCA
CACCCGAATGGCGCCACTTCATCGACAAACAGGTACAGCCAACCATGTCCCAGTTCGAAATG
GACACGTATGCTAAGAGCCACGACCTTATGTCAGGTTTCTGGAATGCCTGCTATGACATGCT
TATGAGCAGTGGGCAGCGGCGCCAGTGGGAGCGCGCCCAGAGTCGTCGGGCCTTCCAGGAGC
TGGTGCTGGAACCTGCGCAGAGGCGGGCGCGCCTGGAGGGGCTACGCTACACGGCAGTGCTG
AAGCAGCAGGCAACGCAGCACTCCATGGCCCTGCTGCACTGGGGGGCGCTGTGGCGCCAGCT
CGCCAGCCCATGTGGGGCCTGGGCGCTGAGGGACACTCCCATCCCCGCTGGAAACTGTCCA
GCGCCGAGACATATTCACGCATGCGTCTGAAGCTGGTGCCCAACCATCACTTCGACCCTCAC
CTGGAAGCCAGCGCTCTCCGAGACAATCTGGGTGAGGTTCCCCTGACACCCACCGAGGAGGC
CTCACTGCCTCTGGCAGTGACCAAAGAGGCCAAAGTGAGCACCCCACCCGAGTTGCTGCAGG
AGGACCAGCTCGGCGAGGACGAGCTGGCTGAGCTGGAGACCCCGATGGAGGCAGCAGAACTG
GATGAGCAGCGTGAGAAGCTGGTGCTGTCGGCCGAGTGCCAGCTGGTGACGGTAGTGGCCGT
GGTCCCAGGGCTGCTGGAGGTCACCACACAGAATGTATACTTCTACGATGGCAGCACTGAGC
GCGTGGAAACCGAGGAGGGCATCGGCTATGATTTCCGGCGCCCACTGGCCCAGCTGCGTGAG
GTCCACCTGCGGCGTTTCAACCTGCGCCGTTCAGCACTTGAGCTCTTCTTTATCGATCAGGC
CAACTACTTCCTCAACTTCCCATGCAAGGTGGGCACGACCCCAGTCTCATCTCCTAGCCAGA
CTCCGAGACCCCAGCCTGGCCCCATCCCACCCCATACCCAGGTACGGAACCAGGTGTACTCG
TGGCTCCTGCGCCTACGGCCCCCCTCTCAAGGCTACCTAAGCAGCCGCTCCCCCCAGGAGAT
GCTGCGTGCCTCAGGCCTTACCCAGAAATGGGTACAGCGTGAGATATCCAACTTCGAGTACT
TGATGCAACTCAACACCATTGCGGGGCGGACCTACAATGACCTGTCTCAGTACCTGTGTTC
CCCTGGGTCCTGCAGGACTACGTGTCCCAACCCTGGACCTCAGCAACCCAGCCGTCTTCCG
GGACCTGTCTAAGCCCATCGGTGTGGTGAACCCCAAGCATGCCCAGCTCGTGAGGGAGAAGT
ATGAAAGCTTTGAGGACCCAGCAGGGACCATTGACAAGTTCCACTATGGCACCCACTACTCC
AATGCAGCAGGCGTGATGCACTACCTCATCGCGTGGAGCCCTTCACCTCCCTGCACGTCCA
GCTGCAAAGTGGCCGCTTTGACTGCTCCGACCGGCAGTTCCACTCGGTGGCGGCAGCCTGGC
AGGCACGCCTGGAGAGCCCTGCCGATGTGAAGGAGCTCATCCCGGAATTCTTCTACTTTCCT
GACTTCCTGGAGAACCAGAACGGTTTTGACCTGGGCTGTCTCCAGCTGACCAACGAGAAGGT
AGGCGATGTGGTGCTACCCCCGTGGGCCAGCTCTCCTGAGGACTTCATCCAGCAGCACCGCC
AGGCTCTGGAGTCGGAGTATGTGTCTGCACACCTACACGAGTGGATCGACCTCATCTTTGGC
TACAAGCAGCGGGGGCCAGCCGCCGAGGAGGCCCTCAATGTCTTCTATTACTGCACCTATGA
GGGGGCTGTAGACCTGGACCATGTGACAGATGAGCGGGAACGGAAGGCTCTGGAGGGCATTA
TCAGCAACTTTGGGCAGACTCCCTGTCAGCTGCTGAAGGAGCCACATCCAACTCGGCTCTCA
GCTGAGGAAGCAGCCCATCGCCTTGCACGCCTGGACACTAACTCACCTAGCATCTTCCAGCA
CCTGGACGAACTCAAGGCATTCTTCGCAGAGGTGACTGTGAGTGCCAGTGGGCTGCTGGGCA
CCCACAGCTGGTTGCCCTATGACCGCAACATAAGCAACTACTTCAGCTTCAGCAAAGACCCC
ACCATGGGCAGCCACAAGACGCAGCGACTGCTGAGTGGCCCGTGGGTGCCAGGCAGTGGTGT
GAGTGGACAAGCACTGGCAGTGGCCCCGGATGGAAAGCTGCTATTCAGCGGTGGCCACTGGG
ATGGCAGCCTGCGGGTGACTGCACTACCCCGTGGCAAGCTGTTGAGCCAGCTCAGCTGCCAC
CTTGATGTAGTAACCTGCCTTGCACTGGACACCTGTGGCATCTACCTCATCTCAGGCTCCCG
GGACACCACGTGCATGGTGTGGCGGCTCCTGCATCAGGGTGGTCTGTCAGTAGGCCTGGCAC
CAAAGCCTGTGCAGGTCCTGTATGGGCATGGGGCTGCAGTGAGCTGTGTGGCCATCAGCACT
GAACTTGACATGGCTGTGTCTGGATCTGAGGATGGAACTGTGATCATACACACTGTACGCCG
CGGACAGTTTGTAGCGGCACTACGGCCTCTGGGTGCCACATTCCCTGGACCTATTTTCCACC
TGGCATTGGGGTCCGAAGGCCAGATTGTGGTACAGAGCTCAGCGTGGGAACGTCCTGGGGCC
CAGGTCACCTACTCCTTGCACCTGTATTCAGTCAATGGAAGTTGCGGGCTTCACTGCCCCT
GGCAGAGCAGCCTACAGCCCCTGACGGTGACAGAGGACTTTGTGTTGCTGGGCACCGCCAGT
GCGCCCTGCACATCCTCCAACTAAACACACTGCTCCCGGCCGCGCCTCCCTTGCCCATGAAG
GTGGCCATCCGCAGCGTGGCCGTGACCAAGGAGCGCAGCCACGTGCTGGTGGGCCTGGAGGA
TGGCAAGCTCATCGTGGTGGTCGCGGGGCAGCCCTCTGAGGTGCGCAGCAGCCAGTTCGCGC
GGAAGCTGTGGCGGTCCTCGCGGCGCATCTCCCAGGTGTCCTCGGGAGAGACGGAATACAAC
CCTACTGAGGCGCGCTGAACCTGGCCAGTCCGGCTGCTCGGGCCCGCCCCGGCAGGCCTG
GCCCGGGAGGCCCCGCCCAGAAGTCGGCGGGAACACCCGGGGTGGGAGCCCAGGGGGTGA
GCGGGGCCCACCCTGCCCAGCTCAGGGATTGGCGGGCGATGTTACCCCCTCAGGGATTGGCG
GGCGGAAGTCCCGCCCCTCGCCGGCTGAGGGGCCGCCCTGAGGGCCAGCACTGGCGTCT
```

FIGURE 23

MSQFEMDTYAKSHDLMSGFWNACYDMLMSSGQRRQWERAQSRRAFQELVLEPAQRRARLEGL
RYTAVLKQQATQHSMALLHWGALWRQLASPCGAWALRDTPIPRWKLSSAETYSRMRLKLVPN
HHFDPHLEASALRDNLGEVPLTPTEEASLPLAVTKEAKVSTPPELLQEDQLGEDELAELETP
MEAAELDEQREKLVLSAECQLVTVVAVVPGLLEVTTQNVYFYDGSTERVETEEGIGYDFRRP
LAQLREVHLRRFNLRRSALELFFIDQANYFLNFPCKVGTTPVSSPSQTPRPQPGPIPPHTQV
RNQVYSWLLRLRPPSQGYLSSRSPQEMLRASGLTQKWVQREISNFEYLMQLNTIAGRTYNDL
SQYPVFPWVLQDYVSPTLDLSNPAVFRDLSKPIGVVNPKHAQLVREKYESFEDPAGTIDKFH
YGTHYSNAAGVMHYLIRVEPFTSLHVQLQSGRFDCSDRQFHSVAAAWQARLESPADVKELIP
EFFYFPDFLENQNGFDLGCLQLTNEKVGDVVLPPWASSPEDFIQQHRQALESEYVSAHLHEW
IDLIFGYKQRGPAAEEALNVFYYCTYEGAVDLDHVTDERERKALEGIISNFGQTPCQLLKEP
HPTRLSAEEAAHRLARLDTNSPSIFQHLDELKAFFAEVTVSASGLLGTHSWLPYDRNISNYF
SFSKDPTMGSHKTQRLLSGPWVPGSGVSGQALAVAPDGKLLFSGGHWDGSLRVTALPRGKLL
SQLSCHLDVVTCLALDTCGIYLISGSRDTTCMVWRLLHQGGLSVGLAPKPVQVLYGHGAAVS
CVAISTELDMAVSGSEDGTVIIHTVRRGQFVAALRPLGATFPGPIFHLALGSEGQIVVQSSA
WERPGAQVTYSLHLYSVNGKLRASLPLAEQPTALTVTEDFVLLGTAQCALHILQLNTLLPAA
PPLPMKVAIRSVAVTKERSHVLVGLEDGKLIVVVAGQPSEVRSSQFARKLWRSSRRISQVSS
GETEYNPTEAR

N-glycosylation site.

amino acids 677-681 cAMP- and cGMP-dependent protein kinase phosphorylation site.

amino acids 985-989

Tyrosine kinase phosphorylation site.

amino acids 56-65, 367-376, 543-551

N-myristoylation site.

amino acids 61-67, 436-442, 604-610, 610-616, 664-670, 691-697,
706-712, 711-717, 769-775, 785-791, 802-808, 820-826, 834-840,
873-879, 912-918, 954-960

FIGURE 24

CGGACGCGTGGGCGGACGCGTGGGGGCTGTGAGAAAGTGCCAATAAATACATCATGCAACCC
CACGGCCCACCTTGTGAACTCCTCGTGCCCAGGGCTGATGTGCGTCTTCCAGGGCTACTCAT
CCAAAGGCCTAATCCAACGTTCTGTCTTCAATCTGCAAATCTATGGGGTCCTGGGGCTCTTC
TGGACCCTTAACTGGGTACTGGCCCTGGGCCAATGCGTCCTCGCTGGAGCCTTTGCCTCCTT
CTACTGGGCCTTCCACAAGCCCCAGGACATCCCTACCTTCCCCTTAATCTCTGCCTTCATCC
GCACACTCCGTTACCACACTGGGTCATTGGCATTTGGAGCCCTCATCCTGACCCTTGTGCAG
ATAGCCCGGGTCATCTTGGAGTATATTGACCACAAGCTCAGAGGAGTGCAGAACCCTGTAGC
CCGCTGCATCATGTGCTGTTTCAAGTGCTGCCTCTGGTGTCTGGAAAAATTTATCAAGTTCC
TAAACCGCAATGCATACATCATGATCGCCATCTACGGGAAGAATTTCTGTGTCTCAGCCAAA
AATGCGTTCATGCTACTCATGCGAAACATTGTCAGGGTGGTCGTCCTGGACAAAGTCACAGA
CCTGCTGCTGTTCTTTGGGAAGCTGCTGGTGGTCGGAGGCGTGGGGGTCCTGTCCTTCTTTT
TTTTCTCCGGTCGCATCCCGGGGCTGGGTAAAGACTTTAAGAGCCCCACCTCAACTATTAC
TGGCTGCCCATCATGACCTCCATCCTGGGGCCTATGTCATCGCCAGCGGCTTCTTCAGCGT
TTTCGGCATGTGTGTGGACACGCTCTTCCTCTGCTTCCTGGAAGACCTGGAGCGGAACAACG
GCTCCCTGGACCGGCCCTACTACATGTCCAAGAGCCTTCTAAAGATTCTGGGCAAGAAGAAC
GAGGCGCCCCGGACAACAAGAAGAGGAAGAAGTGACAGCTCCGGCCCTGATCCAGGACTGC
ACCCCACCCCCACCGTCCAGCCATCCAACCTCACTTCGCCTTACAGGTCTCCATTTTGTGGT
AAAAAAGGTTTTAGGCCAGGCGCCGTGGCTCACGCCTGTAATCCAACACTTTGAGAGGCTG
AGGCGGCGGATCACCTGAGTCAGGAGTTCGAGACCAGCCTGGCCAACATGGTGAAACCTCC
GTCTCTATTAAAAATACAAAAATTAGCCGAGAGTGGTGGCATGCACCTGTCATCCCAGCTAC
TCGGGAGGCTGAGGCAGGAGAATCGCTTGAACCCGGGAGGCAGAGGTTGCAGTGAGCCGAGA
TCGCGCCACTGCACTCCAACCTGGGTGACAGACTCTGTCTCCAAAACAAAACAAACAAACAA
AAAGATTTTATTAAAGATATTTTGTTAACTC

FIGURE 25

RTRGRTRGGCEKVPINTSCNPTAHLVNSSCPGLMCVFQGYSSKGLIQRSVFNLQIYGVLGLF
WTLNWVLALGQCVLAGAFASFYWAFHKPQDIPTFPLISAFIRTLRYHTGSLAFGALILTLVQ
IARVILEYIDHKLRGVQNPVARCIMCCFKCCLWCLEKFIKFLNRNAYIMIAIYGKNFCVSAK
NAFMLLMRNIVRVVVLDKVTDLLLFFGKLLVVGGVGVLSFFFFSGRIPGLGKDFKSPHLNYY
WLPIMTSILGAYVIASGFFSVFGMCVDTLFLCFLEDLERNNGSLDRPYYMSKSLLKILGKKN
EAPPDNKKRKK

FIGURE 26

GAGTCTTGACCGCCGCCGGGCTCTTGGTACCTCAGCGCGAGCGCCAGGCGTCCGGCCGCCGT
GGCTATGTTCGTGTCCGATTTCCGCAAAGAGTTCTACGAGGTGGTCCAGAGCCAGAGGGTCC
TTCTCTTCGTGGCCTCGGACGTGGATGCTCTGTGTGCGTGCAAGATCCTTCAGGCCTTGTTC
CAGTGTGACCACGTGCAATATACGCTGGTTCCAGTTTCTGGGTGGCAAGAACTTGAAACTGC
ATTTCTTGAGCATAAAGAACAGTTTCATTATTTTATTCTCATAAACTGTGGAGCTAATGTAG
ACCTATTGGATATTCTTCAACCTGATGAAGACACTATATTCTTTGTGTGTGACTCCCATAGG
CCAGTCAATGTCGTCAATGTATACAACGATACCCAGATCAAATTACTCATTAAACAAGATGA
TGACCTTGAAGTTCCCGCCTATGAAGACATCTTCAGGGATGAAGAGGAGGATGAAGAGCATT
CAGGAAATGACAGTGATGGGTCAGAGCCTTCTGAGAAGCGCACACGGTTAGAAGAGGAGATA
GTGGAGCAAACCATGCGGAGGAGGCAGCGGCGAGAGTGGGAGGCCCGGAGAAGAGACATCCT
CTTTGACTACGAGCAGTATGAATATCATGGGACATCGTCAGCCATGGTGATGTTTGAGCTGG
CTTGGATGCTGTCCAAGGACCTGAATGACATGCTGTGGTGGCCATCGTTGGACTAACAGAC
CAGTGGGTGCAAGACAAGATCACTCAAATGAAATACGTGACTGATGTTGGTGTCCTGCAGCG
CCACGTTTCCCGCCACAACCACCGGAACGAGGATGAGGAGAACACACTCTCCGTGGACTGCA
CACGGATCTCCTTTGAGTATGACCTCCGCCTGGTGCTCTACCAGCACTGGTCCCTCCATGAC
AGCCTGTGCAACACCAGCTATACCGCAGCCAGGTTCAAGCTGTGGTCTGTGCATGGACAGAA
GCGGCTCCAGGAGTTCCTTGCAGACATGGGTCTTCCCCTGAAGCAGGTGAAGCAGAAGTTCC
AGGCCATGGACATCTCCTTGAAGGAGAATTTGCGGGAAATGATTGAAGAGTCTGCAAATAAA
TTTGGGATGAAGGACATGCGCGTGCAGACTTTCAGCATTCATTTGGGTTCAAGCACAAGTT
TCTGGCCAGCGACGTGGTCTTTGCCACCATGTCTTTGATGGAGAGCCCCGAGAAGGATGGCT
CAGGGACAGATCACTTCATCCAGGCTCTGGACAGCCTCTCCAGGAGTAACCTGGACAAGCTG
TACCATGGCCTGGAACTCGCCAAGAAGCAGCTGCGAGCCACCCAGCAGACCATTGCCAGCTGC
CTTTGCACCAACCTCGTCATCTCCCAGGGGCCTTTCCTGTACTGCTCTCTCATGGAGGGCAC
TCCAGATGTCATGCTGTTCTCTAGGCCGGCATCCCTAAGCCTGCTCAGCAAACACCTGCTCA
AGTCCTTTGTGTGTTCGACAAAGAACCGGCGCTGCAAACTGCTGCCCCTGGTGATGGCTGCC
CCCCTGAGCATGGAGCATGGCACAGTGACCGTGGTGGGCATCCCCCAGAGACCGACAGCTC
GGACAGGAAGAACTTTTTGGGAGGCGTTTGAGAAGGCAGCGGAAAGCACCAGCTCCCGGA
TGCTGCACAACCATTTTGACCTCTCAGTAATTGAGCTGAAAGCTGAGGATCGGAGCAAGTTT
CTGGACGCACTTATTTCCCTCCTGTCCTAGGAATTTGATTCTTCCAGAATGACCTTCTTATT
TATGTAACTGGCTTTCATTTAGATTGTAAGTTATGGACATGATTTGAGATGTAGAAGCCATT
TTTTATTAAATAAATGCTTATTTTAGGAAA

FIGURE 27

MFVSDFRKEFYEVVQSQRVLLFVASDVDALCACKILQALFQCDHVQYTLVPVSGWQELETAF
LEHKEQFHYFILINCGANVDLLDILQPDEDTIFFVCDSHRPVNVVNVYNDTQIKLLIKQDDD
LEVPAYEDIFRDEEEDEEHSGNDSDGSEPSEKRTRLEEEIVEQTMRRRQRREWEARRRDILF
DYEQYEYHGTSSAMVMFELAWMLSKDLNDMLWWAIVGLTDQWVQDKITQMKYVTDVGVLQRH
VSRHNHRNEDEENTLSVDCTRISFEYDLRLVLYQHWSLHDSLCNTSYTAARFKLWSVHGQKR
LQEFLADMGLPLKQVKQKFQAMDISLKENLREMIEESANKFGMKDMRVQTFSIHFGFKHKFL
ASDVVFATMSLMESPEKDGSGTDHFIQALDSLSRSNLDKLYHGLELAKKQLRATQQTIASCL
CTNLVISQGPFLYCSLMEGTPDVMLFSRPASLSLLSKHLLKSFVCSTKNRRCKLLPLVMAAP
LSMEHGTVTVVGIPPETDSSDRKNFFGRAFEKAAESTSSRMLHNHFDLSVIELKAEDRSKFL
DALISLLS

FIGURE 28

GTACCTCAGCGCGAGCGCCAGGCGTCCGGCCGCCGTGGCTATGNTCGTGTCCGATTTCCGCA
AAGAGTTCTACGAGGTGGTCCAGAGCCAGAGGGTCCTTCTCTTCGTGGCCTCGGANGTGGAT
GCTCTGTGTGCGTGCAAGATCCTTCAGGCCTTGTTCCAGTGTGACCANGTGCAATATANGCT
GGTTCCAGTTTCTGGGTGGCAAGAACTTGAAACTGCATTTCTTGAGCATAAAGAACAGTTTC
ATTATTTTATTCTCATAAACTGTGGAGCTAATGTAGACCTATTGGATATTCTTCAACCTGAT
GAAGACACTATATTCTTTGTGTGTGACACCCATAGGCCAGTCAATGTTGTCAATGTATACAA
CGATACCC

FIGURE 29

```
CAGGAACCCTCTCTTTGGGTCTGGATTGGGACCCCTTTCCAGTACCATTTTTTCTAGTGAAC
CACGAAGGGACGATACCAGAAAACACCCTCAACCCAAAGGAAATAGACTACAGCCCCAATTG
GCTGACTTTGGCTATAGAAAAAAGAAAGGAACGAAAAGAGACAGTTTTTTTTGGAAAGCTAA
GTCTTCCCTTTATCGAGTCAAGAAACCCCCCCTTCTTGAGCTATTTACAGCTTTTAACAATT
GAGTAAAGTACGCTCCGGTCACCATGGTGACAGCCGCCCTGGGTCCCGTCTGGGCAGCGCTC
CTGCTCTTTCTCCTGATGTGTGAGATCCGTATGGTGGAGCTCACCTTTGACAGAGCTGTGGC
CAGCGGCTGCCAACGGTGCTGTGACTCTGAGGACCCCTGGATCCTGCCCATGTATCCTCAG
CCTCTTCCTCCGGCCGCCCCACGCCCTGCCTGAGATCAGACCCTACATTAATATCACCATC
CTGAAGGGTGACAAAGGGGACCCAGGCCCAATGGGCCTGCCAGGGTACATGGGCAGGGAGGG
TCCCCAAGGGGAGCCTGGCCCTCAGGGCAGCAAGGGTGACAAGGGGAGATGGGCAGCCCCG
GCGCCCCGTGCCAGAAGCGCTTCTTCGCCTTCTCAGTGGGCCGCAAGACGGCCCTGCACAGC
GGCGAGGACTTCCAGACGCTGCTCTTCGAAAGGGTCTTTGTGAACCTTGATGGGTGCTTTGA
CATGGCGACCGGCCAGTTTGCTGCTCCCCTGCGTGGCATCTACTTCTTCAGCCTCAATGTGC
ACAGCTGGAATTACAAGGAGACGTACGTGCACATTATGCATAACCAGAAAGAGGCTGTCATC
CTGTACGCGCAGCCCAGCGAGCGCAGCATCATGCAGAGCCAGAGTGTGATGCTGGACCTGGC
CTACGGGGACCGCGTCTGGGTGCGGCTCTTCAAGCGCCAGCGCGAGAACGCCATCTACAGCA
ACGACTTCGACACCTACATCACCTTCAGCGGCCACCTCATCAAGGCCGAGGACGACTGAGGG
CCTCTGGGCCACCCTCCCGGCTGGAGAGCTCAGGTGCTGGTCCCGTCCCCTGCAGGGCTCAG
TTTGCACTGCTGTGAAGCAGGAAGGCCAGGGAGGTCCCGGGGACCTGGCATTCTGGGGAGA
CCCTGCTTCTATCTTGGCTGCCATCATCCCTCCCAGCCTATTTCTGCTCCTCTCTTCTCTCT
TGGACCTATTTTAAGAAGCTTGCTAACCTAAATATTCTAGAACTTTCCCAGCCTCGTAGCCC
AGCACTTCTCAAACTTGGAAATGCATGCGAATCACCCGGGGTTCGTGTTAAATGCAGATTCT
GACTCAGCAGGTCTGAGTGGGTCCAGGATTCTGTGTTTCTCATATGTTCCTGGGTGATGCTG
ATGGGGTCAGTCTATGAACCACACTGGAGCAACCAGGTTCTAGGACTTTCTCAATATTCTAG
TACTTTCTGAACATTCTGGAATCCTCCCCACATTCTAGAATTCTCCCAACATTTTTTTTTCT
TGAGACAGAGTCTTGCTCTGTTGCCCAGGCTAGAGTGCAGTGGTGCAATCTCAGTTCACTGC
AACCTCTGCCTCCCGGGTTCAAGCGATTCTTCTGCCTCAGCCTCCCTAGTGGCTGGGATTAC
AGGCGCCTGCTACCATGCCTGGCTAATTTTTGTATTTTTAGTAGAGATGGGGTTTCACCATA
TTGGCCAGGCTGGTCTTGAACTCCTGACTTCAGGTGACCCACCCGCCTCGGCCTCTCAAAAT
GCTGGGATTACAGGTGTGAGCCACCGTGCCTGGCCAATTCCAACATTCTTAAATTCTCTCAT
CCCTCCAGGGCTCCCCGTGCTATGTTCTCTTTACCCCTTCCCCCTCTTCTCTTGCTCAGGCC
TGCACCACTGCAGCCACCGTTCATTTATTCATTCATTAAACACTGAGCACTCACTCTGTGCT
GGGTCCCGGGAAGGGTGAGGGGGTCAGACACAGGCCCTGCCCCTGCCCTCAGTGACTGGCCA
GTCCAGCCCAGGCGGGGAGAGATGTGTACATAGGTTTTAAAGCAGACCCAGAGCTCATGGGG
GCCTGTGTTCTGGGTGTTCAGGTGCTGCTGGTCCTCCATTACCCACTGCTCCCCAAGGCTGG
TGGGACGGGGTCCCGGTGGCAGGGGCAGGTATCTCCTTCCCGTTCCTCATCCACCTGCCCAG
TGCTCATCGTTACAGCAAACCCCAGGGGGCCTTGGCCAGGTCAAGGGTTCTGTGAGGAGAGG
ACCCAGGAGTGTGGGGGCATTTGGGGGGTGAAGTGGCCCCCGAAGAATGGAACCCACACCCA
TAGCTCTCCCCACAGCTGATACGGCATCCTGCGAGAAGACCTGCCCTCCTCACTGGGATCCC
CTTCCTGCCTCCTCCCAGGGCTCTGCCAGGGCCTTGCTCAGTCCCTTCCACCAAAGTCATCT
GAACTTCCGTTTCCCCAGGGCCTCCAGCTGCCCTCAGACACTGATGTCTGTCCCCAGGTGCT
CTCTGCCCCTCATGCCCCTCTCACCGGCCCAGTGCCCCGACTCTCCAGGCTTTATCAAGGTG
CTAAGGCCCGGGTGGGCAGCTCCTCGTCTCAGAGCCTCCTCCGGCCTGGTGCTGCCTTTAC
AAACACCTGCAGGAGAAGGGCCACGGAAGCCCAGGCTTTAGAGCCCTCAGCAGGTCTGGGG
AGCTAGAGCAAAGGAGGGACCTCAGGCCTTCCGTTTCTTCTTCCAGGGTGGGGTGGCCTGGT
GTTCCCCTAGCCTTCCAAACCCAGGTGGCCTGCCCTTCTCCCCAGAGGGAGGCGGCCTCCGC
CCATTGGTGCTCATGCAGACTCTGGGGCTGAGGTGCCCCGGGGGGTGATCTCTGGTGCTCAC
AGCCGAGGGAGCCGTGGCTCCATGGCCAGATGACGGAAACAGGGTCTGACCAAGTGCCAGGA
AGACCTGTGCTATAAACCACCCTGCCTGATCCTGCCCCTGCCTGACCCCGCCACGCCCTGCC
GTCCAGCATGATTAAAGAATGCTGTCTCCTCTTGGAAAAAAAAAAAAAAA
```

FIGURE 30

MVTAALGPVWAALLLFLLMCEIRMVELTFDRAVASGCQRCCDSEDPLDPAHVSSASSSGRPH
ALPEIRPYINITILKGDKGDPGPMGLPGYMGREGPQGEPGPQGSKGDKGFMGSPGAPCQKRF
FAFSVGRKTALHSGEDFQTLLFERVFVNLDGCFDMATGQFAAPLRGIYFFSLNVHSWNYKET
YVHIMHNQKEAVILYAQPSERSIMQSQSVMLDLAYGDRVWVRLFKRQRENAIYSNDFDTYIT
FSGHLIKAEDD

Important features:

Signal peptide:
amino acids 1-20

N-glycosylation site.
amino acids 72-75

C1q domain proteins.
amino acids 144-178, 78-111 and 84-117

FIGURE 31

```
ACTCGAACGCAGTTGCTTCGGGACCCAGGACCCCCTCGGGCCCGACCCGCCAGGAAAGACTG
AGGCCGCGGCCTGCCCCGCCCGGCTCCCTGCGCCGCCGCCGCCTCCCGGGACAGAAGATGTG
CTCCAGGGTCCCTCTGCTGCTGCCGCTGCTCCTGCTACTGGCCCTGGGGCCTGGGGTGCAGG
GCTGCCCATCCGGCTGCCAGTGCAGCCAGCCACAGACAGTCTTCTGCACTGCCCGCCAGGGG
ACCACGGTGCCCCGAGACGTGCCACCCGACACGGTGGGGCTGTACGTCTTTGAGAACGGCAT
CACCATGCTCGACGCAGGCAGCTTTGCCGGCCTGCCGGGCCTGCAGCTCCTGGACCTGTCAC
AGAACCAGATCGCCAGCCTGCCCAGCGGGGTCTTCCAGCCACTCGCCAACCTCAGCAACCTG
GACCTGACGGCCAACAGGCTGCATGAAATCACCAATGAGACCTTCCGTGGCCTGCGGCGCCT
CGAGCGCCTCTACCTGGGCAAGAACCGCATCCGCCACATCCAGCCTGGTGCCTTCGACACGC
TCGACCGCCTCCTGGAGCTCAAGCTGCAGGACAACGAGCTGCGGGCACTGCCCCGCTGCGC
CTGCCCCGCCTGCTGCTGCTGGACCTCAGCCACAACAGCCTCCTGGCCCTGGAGCCCGGCAT
CCTGGACACTGCCAACGTGGAGGCGCTGCGGCTGGCTGGTCTGGGGCTGCAGCAGCTGGACG
AGGGGCTCTTCAGCCGCTTGCGCAACCTCCACGACCTGGATGTGTCCGACAACCAGCTGGAG
CGAGTGCCACCTGTGATCCGAGGCCTCCGGGGCCTGACGCGCCTGCGGCTGGCCGGCAACAC
CCGCATTGCCCAGCTGCGGCCCGAGGACCTGGCCGGCCTGGCTGCCCTGCAGGAGCTGGATG
TGAGCAACCTAAGCCTGCAGGCCCTGCCTGGCGACCTCTCGGGCCTCTTCCCCCGCCTGCGG
CTGCTGGCAGCTGCCCGCAACCCCTTCAACTGCGTGTGCCCCCTGAGCTGGTTTGGCCCCTG
GGTGCGCGAGAGCCACGTCACACTGGCCAGCCCTGAGGAGACGCGCTGCCACTTCCCGCCCA
AGAACGCTGGCCGGCTGCTCCTGGAGCTTGACTACGCCGACTTTGGCTGCCCAGCCACCACC
ACCACAGCCACAGTGCCCACCACGAGGCCCGTGGTGCGGGAGCCCACAGCCTTGTCTTCTAG
CTTGGCTCCTACCTGGCTTAGCCCCACAGCGCCGGCCACTGAGGCCCCAGCCCGCCCTCCA
CTGCCCCACCGACTGTAGGGCCTGTCCCCAGCCCCAGGACTGCCCACCGTCCACCTGCCTC
AATGGGGGCACATGCCACCTGGGGACACGGCACCACCTGGCGTGCTTGTGCCCCGAAGGCTT
CACGGGCCTGTACTGTGAGAGCCAGATGGGGCAGGGGACACGGCCCAGCCCTACACCAGTCA
CGCCGAGGCCACCACGGTCCCTGACCCTGGGCATCGAGCCGGTGAGCCCCACCTCCCTGCGC
GTGGGGCTGCAGCGCTACCTCCAGGGGAGCTCCGTGCAGCTCAGGAGCCTCCGTCTCACCTA
TCGCAACCTATCGGGCCCTGATAAGCGGCTGGTGACGCTGCGACTGCCTGCCTCGCTCGCTG
AGTACACGGTCACCCAGCTGCGGCCCAACGCCACTTACTCCGTCTGTGTCATGCCTTTGGGG
CCCGGGCGGGTGCCGGAGGGCGAGGAGGCCTGCGGGGAGGCCCATACACCCCAGCCGTCCA
CTCCAACCACGCCCCAGTCACCCAGGCCCGCGAGGGCAACCTGCCGCTCCTCATTGCGCCCG
CCCTGGCCGCGGTGCTCCTGGCCGCGCTGGCTGCGGTGGGGGCAGCCTACTGTGTGCGGCGG
GGGCGGGCCATGGCAGCAGCGGCTCAGGACAAAGGGCAGGTGGGGCCAGGGGCTGGGCCCCT
GGAACTGGAGGGAGTGAAGGTCCCCTTGGAGCCAGGCCCGAAGGCAACAGAGGGCGGTGGAG
AGGCCCTGCCCAGCGGGTCTGAGTGTGAGGTGCCACTCATGGGCTTCCCAGGGCCTGGCCTC
CAGTCACCCCTCCACGCAAAGCCCTACATCTAAGCCAGAGAGAGACAGGGCAGCTGGGGCCG
GGCTCTCAGCCAGTGAGATGGCCAGCCCCCTCCTGCTGCCACACCACGTAAGTTCTCAGTCC
CAACCTCGGGGATGTGTGCAGACAGGGCTGTGTGACCACAGCTGGGCCCTGTTCCCTCTGGA
CCTCGGTCTCCTCATCTGTGAGATGCTGTGGCCCAGCTGACGAGCCCTAACGTCCCCAGAAC
CGAGTGCCTATGAGGACAGTGTCCGCCCTGCCCTCCGCAACGTGCAGTCCCTGGGCACGGCG
GGCCCTGCCATGTGCTGGTAACGCATGCCTGGGTCCTGCTGGGCTCTCCCACTCCAGGCGGA
CCCTGGGGGCCAGTGAAGGAAGCTCCCGGAAAGAGCAGAGGGAGAGCGGGTAGGCGGCTGTG
TGACTCTAGTCTTGGCCCCAGGAAGCGAAGGAACAAAAGAAACTGGAAAGGAAGATGCTTTA
GGAACATGTTTTGCTTTTTTAAAATATATATATTTATAAGAGATCCTTTCCCATTTATTCTG
GGAAGATGTTTTTCAAACTCAGAGACAAGGACTTTGGTTTTTGTAAGACAAACGATGATATG
AAGGCCTTTTGTAAGAAAAAATAAAAGATGAAGTGTGAAA
```

FIGURE 32

```
MCSRVPLLLPLLLLLALGPGVQGCPSGCQCSQPQTVFCTARQGTTVPRDVPPDTVGLYVFEN
GITMLDAGSFAGLPGLQLLDLSQNQIASLPSGVFQPLANLSNLDLTANRLHEITNETFRGLR
RLERLYLGKNRIRHIQPGAFDTLDRLLELKLQDNELRALPPLRLPRLLLLDLSHNSLLALEP
GILDTANVEALRLAGLGLQQLDEGLFSRLRNLHDLDVSDNQLERVPPVIRGLRGLTRLRLAG
NTRIAQLRPEDLAGLAALQELDVSNLSLQALPGDLSGLFPRLRLLAAARNPFNCVCPLSWFG
PWVRESHVTLASPEETRCHFPPKNAGRLLLELDYADFGCPATTTTATVPTTRPVVREPTALS
SSLAPTWLSPTAPATEAPSPPSTAPPTVGPVPQPQDCPPSTCLNGGTCHLGTRHHLACLCPE
GFTGLYCESQMGQGTRPSPTPVTPRPPRSLTLGIEPVSPTSLRVGLQRYLQGSSVQLRSLRL
TYRNLSGPDKRLVTLRLPASLAEYTVTQLRPNATYSVCVMPLGPGRVPEGEEACGEAHTPPA
VHSNHAPVTQAREGNLPLLIAPALAAVLLAALAAVGAAYCVRRGRAMAAAAQDKGQVGPGAG
PLELEGVKVPLEPGPKATEGGGEALPSGSECEVPLMGFPGPGLQSPLHAKPYI
```

FIGURE 33

```
GAATCATCCACGCACCTGCAGCTCTGCTGAGAGAGTGCAAGCCGTGGGGGTTTTGAGCTCAT
CTTCATCATTCATATGAGGAAATAAGTGGTAAAATCCTTGGAAATACAATGAGACTCATCAG
AAACATTTACATATTTTGTAGTATTGTTATGACAGCAGAGGGTGATGCTCCAGAGCTGCCAG
AAGAAAGGGAACTGATGACCAACTGCTCCAACATGTCTCTAAGAAAGGTTCCCGCAGACTTG
ACCCCAGCCACAACGACACTGGATTTATCCTATAACCTCCTTTTTCAACTCCAGAGTTCAGA
TTTTCATTCTGTCTCCAAACTGAGAGTTTTGATTCTATGCCATAACAGAATTCAACAGCTGG
ATCTCAAAACCTTTGAATTCAACAAGGAGTTAAGATATTTAGATTTGTCTAATAACAGACTG
AAGAGTGTAACTTGGTATTTACTGGCAGGTCTCAGGTATTTAGATCTTTCTTTTAATGACTT
TGACACCATGCCTATCTGTGAGGAAGCTGGCAACATGTCACACCTGGAAATCCTAGGTTTGA
GTGGGGCAAAAATACAAAAATCAGATTTCCAGAAAATTGCTCATCTGCATCTAAATACTGTC
TTCTTAGGATTCAGAACTCTTCCTCATTATGAAGAAGGTAGCCTGCCCATCTTAAACACAAC
AAAACTGCACATTGTTTTACCAATGGACACAAATTTCTGGGTTCTTTTGCGTGATGGAATCA
AGACTTCAAAAATATTAGAAATGACAAATATAGATGGCAAAAGCCAATTTGTAAGTTATGAA
ATGCAACGAAATCTTAGTTTAGAAAATGCTAAGACATCGGTTCTATTGCTTAATAAAGTTGA
TTTACTCTGGGACGACCTTTTCCTTATCTTACAATTTGTTTGGCATACATCAGTGGAACACT
TTCAGATCCGAAATGTGACTTTTGGTGGTAAGGCTTATCTTGACCACAATTCATTTGACTAC
TCAAATACTGTAATGAGAACTATAAAATTGGAGCATGTACATTTCAGAGTGTTTTACATTCA
ACAGGATAAAATCTATTTGCTTTTGACCAAAATGGACATAGAAAACCTGACAATATCAAATG
CACAAATGCCACACATGCTTTTCCCGAATTATCCTACGAAATTCCAATATTTAAATTTTGCC
AATAATATCTTAACAGACGAGTTGTTTAAAAGAACTATCCAACTGCCTCACTTGAAAACTCT
CATTTTGAATGGCAATAAACTGGAGACACTTTCTTTAGTAAGTTGCTTTGCTAACAACACAC
CCTTGGAACACTTGGATCTGAGTCAAAATCTATTACAACATAAAAATGATGAAAATTGCTCA
TGGCCAGAAACTGTGGTCAATATGAATCTGTCATACAATAAATTGTCTGATTCTGTCTTCAG
GTGCTTGCCCAAAAGTATTCAAATACTTGACCTAAATAATAACCAAATCCAAACTGTACCTA
AAGAGACTATTCATCTGATGGCCTTACGAGAACTAAATATTGCATTTAATTTTCTAACTGAT
CTCCCTGGATGCAGTCATTTCAGTAGACTTTCAGTTCTGAACATTGAAATGAACTTCATTCT
CAGCCCATCTCTGGATTTTGTTCAGAGCTGCCAGGAAGTTAAAACTCTAAATGCGGGAAGAA
ATCCATTCCGGTGTACCTGTGAATTAAAAAATTTCATTCAGCTTGAAACATATTCAGAGGTC
ATGATGGTTGGATGGTCAGATTCATACACCTGTGAATACCCTTTAAACCTAAGGGGAACTAG
GTTAAAAGACGTTCATCTCCACGAATTATCTTGCAACACAGCTCTGTTGATTGTCACCATTG
TGGTTATTATGCTAGTTCTGGGGTTGGCTGTGGCCTTCTGCTGTCTCCACTTTGATCTGCCC
TGGTATCTCAGGATGCTAGGTCAATGCACACAAACATGGCACAGGGTTAGGAAAACAACCCA
AGAACAACTCAAGAGAAATGTCCGATTCCACGCATTTATTTCATACAGTGAACATGATTCTC
TGTGGGTGAAGAATGAATTGATCCCCAATCTAGAGAAGGAAGATGGTTCTATCTTGATTTGC
CTTTATGAAAGCTACTTTGACCCTGGCAAAAGCATTAGTGAAAATATTGTAAGCTTCATTGA
GAAAAGCTATAAGTCCATCTTTGTTTTGTCTCCCAACTTTGTCCAGAATGAGTGGTGCCATT
ATGAATTCTACTTTGCCCACCACAATCTCTTCCATGAAAATTCTGATCATATAATTCTTATC
TTACTGGAACCCATTCCATTCTATTGCATTCCCACCAGGTATCATAAACTGAAAGCTCTCCT
GGAAAAAAAAGCATACTTGGAATGGCCCAAGGATAGGCGTAAATGTGGGCTTTTCTGGGCAA
ACCTTCGAGCTGCTATTAATGTTAATGTATTAGCCACCAGAGAAATGTATGAACTGCAGACA
TTCACAGAGTTAAATGAAGAGTCTCGAGGTTCTACAATCTCTCTGATGAGAACAGATTGTCT
ATAAAATCCCACAGTCCTTGGGAAGTTGGGGACCACATACACTGTTGGGATGTACATTGATA
CAACCTTTATGATGGCAATTTGACAATATTTATTAAAATAAAAAATGGTTATTCCCTTCATA
TCAGTTTCTAGAAGGATTTCTAAGAATGTATCCTATAGAAACACCTTCACAAGTTTATAAGG
GCTTATGGAAAAAGGTGTTCATCCCAGGATTGTTTATAATCATGAAAAATGTGGCCAGGTGC
AGTGGCTCACTCTTGTAATCCCAGCACTATGGGAGGCCAAGGTGGGTGACCCACGAGGTCAA
GAGATGGAGACCATCCTGGCCAACATGGTGAAACCCTGTCTCTACTAAAAATACAAAAATTA
GCTGGGCGTGATGGTGCACGCCTGTAGTCCCAGCTACTTGGGAGGCTGAGGCAGGAGAATCG
CTTGAACCCGGGAGGTGGCAGTTGCAGTGAGCTGAGATCGAGCCACTGCACTCCAGCCTGGT
GACAGAGCGAGACTCCATCTCAAAAAAAAGAAAAAAAAAAAGAAAAAAATGGAAAACATCC
TCATGGCCACAAAATAAGGTCTAATTCAATAAATTATAGTACATTAATGTAATATAATATTA
CATGCCACTAAAAGAATAAGGTAGCTGTATATTTCCTGGTATGGAAAAAACATATTAATAT
GTTATAAACTATTAGGTTGGTGCAAAACTAATTGTGGTTTTGCCATTGAAATGGCATTGAA
ATAAAACTGTAAAGAAATCTATACCAGATGTAGTAACAGTGGTTTGGGTCTGGGAGGTTGGA
TTACAGGGAGCATTTGATTTCTATGTTGTGTATTTCTATAATGTTTGAATTGTTTAGAATGA
ATCTGTATTTCTTTTATAAGTAGAAAAAAAATAAAGATAGTTTTTACAGCCT
```

FIGURE 34

MRLIRNIYIFCSIVMTAEGDAPELPEERELMTNCSNMSLRKVPADLTPATTTLDLSYNLLFQ
LQSSDFHSVSKLRVLILCHNRIQQLDLKTFEFNKELRYLDLSNNRLKSVTWYLLAGLRYLDL
SFNDFDTMPICEEAGNMSHLEILGLSGAKIQKSDFQKIAHLHLNTVFLGFRTLPHYEEGSLP
ILNTTKLHIVLPMDTNFWVLLRDGIKTSKILEMTNIDGKSQFVSYEMQRNLSLENAKTSVLL
LNKVDLLWDDLFLILQFVWHTSVEHFQIRNVTFGGKAYLDHNSFDYSNTVMRTIKLEHVHFR
VFYIQQDKIYLLLTKMDIENLTISNAQMPHMLFPNYPTKFQYLNFANNILTDELFKRTIQLP
HLKTLILNGNKLETLSLVSCFANNTPLEHLDLSQNLLQHKNDENCSWPETVVNMNLSYNKLS
DSVFRCLPKSIQILDLNNNQIQTVPKETIHLMALRELNIAFNFLTDLPGCSHFSRLSVLNIE
MNFILSPSLDFVQSCQEVKTLNAGRNPFRCTCELKNFIQLETYSEVMMVGWSDSYTCEYPLN
LRGTRLKDVHLHELSCNTALLIVTIVVIMLVLGLAVAFCCLHFDLPWYLRMLGQCTQTWHRV
RKTTQEQLKRNVRFHAFISYSEHDSLWVKNELIPNLEKEDGSILICLYESYFDPGKSISENI
VSFIEKSYKSIFVLSPNFVQNEWCHYEFYFAHHNLFHENSDHIILILLEPIPFYCIPTRYHK
LKALLEKKAYLEWPKDRRKCGLFWANLRAAINVNVLATREMYELQTFTELNEESRGSTISLM
RTDCL

FIGURE 35

```
GGGGGCTTTCTTGGGCTTGGCTGCTTGGAACACCTGCCTCCAAGGACCGGCCTCGGAGGGGTCGCCGGGAAAGG
GAGGGAAGAAGGAAGGGCGGGGCCGGCCCCCCTGCGCCCGCCCCGCGCCTCTGCGCGCCCCTGTCCGCCCCGGC
CCAGCCCAGCCCAGCCCCGCGGGCCGGTCACACGCGCAGCCAGCCGGCCGCCTCCCGCGCCCAAGCGCGCCGCT
CTGCTGTGCCCTGCGCCCTTGCCCCGCGCCAGCTTCTGCGCCCGCAGCCCGCCCGGCGCCCCCGGTGACCGTGA
CCCTGCCCTGGGCGCGGGGCGGAGCAGGCATGTCCCGCCGGGGACCGCTACCCCAGCGCTGGCCCTGGTGCTC
CTGGCAGTGACCCTGGCCGGGGTCGGAGCCCAGGGCGCAGCCCTCGAGGACCCTGATTATTACGGGCAGGAGAT
CTGGAGCCGGGAGCCCTACTACGCGCGCCCGGAGCCCGAGCTCGAGACCTTCTCTCCGCCGCTGCCTGCGGGGC
CCGGGGAGGAGTGGGAGCGGCGCCCGCAGGAGCCCAGGCCGCCCAAGAGGGCCACCAAGCCCAAGAAAGCTCCC
AAGAGGGAGAAGTCGGCTCCGGAGCCGCCTCCACCAGGTAAACACAGCAACAAAAAAGTTATGAGAACCAAGAG
CTCTGAGAAGGCTGCCAACGATGATCACAGTGTCCGTGTGGCCCGTGAAGATGTCAGAGAGAGTTGCCCACCTC
TTGGTCTGCAAACCTTAAAAATCACAGACTTCCAGCTCCATGCCTCCACGGTGAAGCGCTATGGCCTGGGGGCA
CATCGAGGGAGACTCAACATCCAGGCGGGCATTAATGAAAATGATTTTTATGACGGAGCGTGGTGCGCGGGAAG
AAATGACCTCCAGCAGTGGATTGAAGTGGATGCTCGGCGCCTGACCAGATTCACTGGTGTCATCACTCAAGGGA
GGAACTCCCTCTGGCTGAGTGACTGGGTGACATCCTATAAGGTCATGGTGAGCAATGACAGCCACACGTGGGTC
ACTGTTAAGAATGGATCTGGAGACATGATATTTGAGGGAAACAGTGAGAAGGAGATCCCTGTTCTCAATGAGCT
ACCCGTCCCCATGGTGGCCCGCTACATCCGCATAAACCCTCAGTCCTGGTTTGATAATGGGAGCATCTGCATGA
GAATGGAGATCCTGGGCTGCCCACTGCCAGATCCTAATAATTATTATCACCGCCGGAACGAGATGACCACCACT
GATGACCTGGATTTTAAGCACCACAATTATAAGGAAATGCGCCAGTTGATGAAAGTTGTGAATGAAATGTGTCC
CAATATCCACCAGAATTTACAACATTGGAAAAAGCCACCAGGGCCTGAAGCTGTATGCTGTGGAGATCTCAGATC
ACCCTGGGGAGCATGAAGTCGGTGAGCCCGAGTTCCACTACATCGCGGGGGCCCACGGCAATGAGGTGCTGGGC
CGGGAGCTGCTGCTGCTGCTGGTGCAGTTCGTGTGTCAGGAGTACTTGGCCCGGAATGCGCGCATCGTCCACCT
GGTGGAGGAGACGCGGATTCACGTCCTCCCCTCCCTCAACCCCGATGGCTACGAGAAGGCCTACGAAGGGGCT
CGGAGCTGGGAGGCTGGTCCCTGGGACGCTGGACCCACGATGGAATTGACATCAACAACAACTTTCCTGATTTA
AACACGCTGCTCTGGGAGGCAGAGGATCGACAGAATGTCCCCAGGAAAGTTCCCAATCACTATATTGCAATCCC
TGAGTGGTTTCTGTCGGAAAATGCCACGGTGGCTGCCGAGACCAGAGCAGTCATAGCCTGGATGGAAAAAATCC
CTTTTGTGCTGGGCGGCAACCTGCAGGGCGGCGAGCTGGTGGTGGCGTATCCCTACGACCTGGTGCGGTCCCCC
TGGAAGACGCAGGAACACACCCCCACCCCCGATGACCACGTGTTCCGCTGGCTGGCCTACTCCTATGCCTCCAC
ACACCGCCTCATGACAGACGCCCGGAGGAGGGTGTGCCACACGGAGGACTTCCAGAAGGAGGAGGGCACTGTCA
ATGGGGCCTCCTGGCACACCGTCGCTGGAAGTCTGAACGATTTCAGCTACCTTCATACAAACTGCTTCGAACTG
TCCATCTACGTGGGCTGTGATAAATACCCACATGAGAGCCAGCTGCCCGAGGAGTGGGAGAATAACCGGGAATC
TCTGATCGTGTTCATGGAGCAGGTTCATCGTGGCATTAAAGGCTTGGTGAGAGATTCACATGGAAAAGGAATCC
CAAACGCCATTATCTCCGTAGAAGGCATTAACCATGACATCCGAACAGCCAACGATGGGGATTACTGGCGCCTC
CTGAACCCTGGAGAGTATGTGGTCACAGCAAAGGCCGAAGGTTTCACTGCATCCACCAAGAACTGTATGGTTGG
CTATGACATGGGGGCCACAAGGTGTGACTTCACACTTAGCAAAACCAACATGGCCAGGATCCGAGAGATCATGG
AGAAGTTTGGGAAGCAGCCCGTCAGCCTGCCAGCCAGGCGGCTGAAGCTGCGGGGGCGGAAGAGACGACAGCGT
GGGTGACCCTCCTGGGCCCTTGAGACTCGTCTGGGACCCATGCAAATTAAACCAACCTGGTAGTAGCTCCATAG
TGGACTCACTCACTGTTGTTTCCTCTGTAATTCAAGAAGTGCCTGGAAGAGAGGGTGCATTGTGAGGCAGGTCC
CAAAAGGGAAGGCTGGAGGCTGAGGCTGTTTTCTTTTCTTTGTTCCCATTTATCCAAATAACTTGGACAGAGCA
GCAGAGAAAAGCTGATGGGAGTGAGAGAACTCAGCAAGCCAACCTGGGAATCAGAGAGAGAAGGCAGAAGGAGGG
GAGCCTGTCCGTTCAGAGCCTCTGGCTGCATAGAAAAGGATTCTGGTGCTTCCCCTGTTTGCGTGGCAGCAAGG
GTTCCACGTGCATTTGCAATTTGCACAGCTAAAATTGCAGCATTTCCCCAGCTGGGCTGTCCCAAATGTTACCA
TTTGAGATGCTCCCAGGCGTCCTAAGAGAATCCACCCTCTCTGGCCCTGGGACATTGCAAGCTGCTACAAATAA
ATTCTGTGTTCTTTTGACAATAGCGTCATTGCCAAGTGCACATCAGTGAGCCTCTTGAATCTGTTTAGTCTCCT
TTTTCAACAAAGGAGTGTGTTCAGAAAAGGAGAGAGAGGCTGAGATCATTCAGGAGTTTGTTGGGCAGCAAGCA
TGGAGCTTCTTGCACAAATTCTGGGTCCATAAACAACCCCCAAAGTCCCTGCTGATCCAGTAGCCCTGGAGGTT
CCCCAGGTAGGGAGAGCCAGAGGTGCCAGCCTTCCTGAAGGGCCAGAAAATTTAGCCTGGATCTCCTCTTTTAC
CTGCTAGGACTGGAAAGAGCCAGAAGTGGGGTGGCCTGAAGCCCTCTCTCTGCTTGAGGTATTGCCCCTGTGTG
GAATTCAGTGCTCATGGGTTGGCCTCATATCAGCCTGGGAGTTATTTTTGATATGTAGAATGCCAGATCTTCCA
GATTAGGCTAAATGTAATGAAAACCTCTTAGGATTATCTGTGGAGCATCAGTTTGGGAAGAATTATTGAATTAT
CTTGCAAGAAAAAGTATGTCTCACTTTTTGTTAATGTTGCTGCCTCATTGACCTGGGAAAAATGAAAAAAAAA
AATAAAGCAAATGGTAAGACCCTTAAAAAAAAAAAAAAAAAAAAAAAAAAAAAAAAAAAAAAAAAAAAAAAAA
```

FIGURE 36

MSRPGTATPALALVLLAVTLAGVGAQGAALEDPDYYGQEIWSREPYYARPEPELETFSPPLP
AGPGEEWERRPQEPRPPKRATKPKKAPKREKSAPEPPPPGKHSNKKVMRTKSSEKAANDDHS
VRVAREDVRESCPPLGLETLKITDFQLHASTVKRYGLGAHRGRLNIQAGINENDFYDGAWCA
GRNDLQQWIEVDARRLTRFTGVITQGRNSLWLSDWVTSYKVMVSNDSHTWVTVKNGSGDMIF
EGNSEKEIPVLNELPVPMVARYIRINPQSWFDNGSICMRMEILGCPLPDPNNYYHRRNEMTT
TDDLDFKHHNYKEMRQLMKVVNEMCPNITRIYNIGKSHQGLKLYAVEISDHPGEHEVGEPEF
HYIAGAHGNEVLGRELLLLLVQFVCQEYLARNARIVHLVEETRIHVLPSLNPDGYEKAYEGG
SELGGWSLGRWTHDGIDINNNFPDLNTLLWEAEDRQNVPRKVPNHYIAIPEWFLSENATVAA
ETRAVIAWMEKIPFVLGGNLQGGELVVAYPYDLVRSPWKTQEHTPTPDDHVFRWLAYSYAST
HRLMTDARRRVCHTEDFQKEEGTVNGASWHTVAGSLNDFSYLHTNCFELSIYVGCDKYPHES
QLPEEWENNRESLIVFMEQVHRGIKGLVRDSHGKGIPNAIISVEGINHDIRTANDGDYWRLL
NPGEYVVTAKAEGFTASTKNCMVGYDMGATRCDFTLSKTNMARIREIMEKFGKQPVSLPARR
LKLRGRKRRQRG

FIGURE 37

```
CTAAGAGGACAAGATGAGGCCCGGCCTCTCATTTCTCCTAGCCCTTCTGTTCTTCCTTGGCCAAGCTGCAGGGG
ATTTGGGGGATGTGGGACCTCCAATTCCCAGCCCCGGCTTCAGCTCTTTCCCAGGTGTTGACTCCAGCTCCAGC
TTCAGCTCCAGCTCCAGGTCGGGCTCCAGCTCCAGCCGCAGCTTAGGCAGCGGAGGTTCTGTGTCCCAGTTGTT
TTCCAATTTCACCGGCTCCGTGGATGACCGTGGGACCTGCCAGTGCTCTGTTTCCCTGCCAGACACCACCTTTC
CCGTGGACAGAGTGGAACGCTTGGAATTCACAGCTCATGTTCTTTCTCAGAAGTTTGAGAAAGAACTTTCTAAA
GTGAGGGAATATGTCCAATTAATTAGTGTGTATGAAAAGAAACTGTTAAACCTAACTGTCCGAATTGACATCAT
GGAGAAGGATACCATTTCTTACACTGAACTGGACTTCGAGCTGATCAAGGTAGAAGTGAAGGAGATGGAAAAAC
TGGTCATACAGCTGAAGGAGAGTTTTGGTGGAAGCTCAGAAATTGTTGACCAGCTGGAGGTGGAGATAAGAAAT
ATGACTCTCTTGGTAGAGAAGCTTGAGACACTAGACAAAAACAATGTCCTTGCCATTCGCCGAGAAATCGTGGC
TCTGAAGACCAAGCTGAAAGAGTGTGAGGCCTCTAAAGATCAAAACACCCCTGTCGTCCACCCTCCTCCCACTC
CAGGGAGCTGTGGTCATGGTGGTGTGGTGAACATCAGCAAACCGTCTGTGGTTCAGCTCAACTGGAGAGGGTTT
TCTTATCTATATGGTGCTTGGGGTAGGGATTACTCTCCCCAGCATCCAAACAAAGGACTGTATTGGGTGGCGCC
ATTGAATACAGATGGGAGACTGTTGGAGTATTATAGACTGTACAACACACTGGATGATTTGCTATTGTATATAA
ATGCTCGAGAGTTGCGGATCACCTATGGCCAAGGTAGTGGTACAGCAGTTTACAACAACAACATGTACGTCAAC
ATGTACAACACCGGGAATATTGCCAGAGTTAACCTGACCACCAACACGATTGCTGTGACTCAAACTCTCCCTAA
TGCTGCCTATAATAACCGCTTTTCATATGCTAATGTTGCTTGGCAAGATATTGACTTTGCTGTGGATGAGAATG
GATTGTGGGTTATTTATTCAACTGAAGCCAGCACTGGTAACATGGTGATTAGTAAACTCAATGACACCACACTT
CAGGTGCTAAACACTTGGTATACCAAGCAGTATAAACCATCTGCTTCTAACGCCTTCATGGTATGTGGGGTTCT
GTATGCCACCCGTACTATGAACACCAGAACAGAAGAGATTTTTTACTATTATGACACAAACACAGGGAAAGAGG
GCAAACTAGACATTGTAATGCATAAGATGCAGGAAAAAGTGCAGAGCATTAACTATAACCCTTTTGACCAGAAA
CTTTATGTCTATAACGATGGTTACCTTCTGAATTATGATCTTTCTGTCTTGCAGAAGCCCCAGTAAGCTGTTTA
GGAGTTAGGGTGAAAGAGAAAATGTTTGTTGAAAAAATAGTCTTCTCCACTTACTTAGATATCTGCAGGGGTGT
CTAAAAGTGTGTTCATTTTGCAGCAATGTTTAGGTGCATAGTTCTACCACACTAGAGATCTAGGACATTTGTCT
TGATTTGGTGAGTTCTCTTGGGAATCATCTGCCTCTTCAGGCGCATTTTGCAATAAAGTCTGTCTAGGGTGGGA
TTGTCAGAGGTCTAGGGGCACTGTGGGCCTAGTGAAGCCTACTGTGAGGAGGCTTCACTAGAAGCCTTAAATTA
GGAATTAAGGAACTTAAAACTCAGTATGGCGTCTAGGGATTCTTTGTACAGGAAATATTGCCCAATGACTAGTC
CTCATCCATGTAGCACCACTAATTCTTCCATGCCTGGAAGAAACCTGGGGACTTAGTTAGGTAGATTAATATCT
GGAGCTCCTCGAGGGACCAAATCTCCAACTTTTTTTTCCCCTCACTAGCACCTGGAATGATGCTTTGTATGTGG
CAGATAAGTAAATTTGGCATGCTTATATATTCTACATCTGTAAAGTGCTGAGTTTTATGGAGAGAGGCCTTTTT
ATGCATTAAATTGTACATGGCAAATAAATCCCAGAAGGATCTGTAGATGAGGCACCTGCTTTTTCTTTTCTCTC
ATTGTCCACCTTACTAAAAGTCAGTAGAATCTTCTACCTCATAACTTCCTTCCAAAGGCAGCTCAGAAGATTAG
AACCAGACTTACTAACCAATTCCACCCCCCACCAACCCCTTCTACTGCCTACTTTAAAAAAATTAATAGTTTT
CTATGGAACTGATCTAAGATTAGAAAATTAATTTTCTTTAATTTCATTATGGACTTTTATTTACATGACTCTA
AGACTATAAGAAATCTGATGGCAGTGACAAAGTGCTAGCATTTATTGTTATCTAATAAAGACCTTGGAGCATA
TGTGCAACTTATGAGTGTATCAGTTGTTGCATGTAATTTTTGCCTTTGTTTAAGCCTGGAACTTGTAAGAAAAT
GAAAATTTAATTTTTTTTCTAGGACGAGCTATAGAAAAGCTATTGAGAGTATCTAGTTAATCAGTGCAGTAGT
TGGAAACCTTGCTGGTGTATGTGATGTGCTTCTGTGCTTTTGAATGACTTTATCATCTAGTCTTTGTCTATTTT
TCCTTTGATGTTCAAGTCCTAGTCTATAGGATTGGCAGTTTAAATGCTTTACTCCCCTTTTAAAATAAATGAT
TAAAATGTGCTTTGAAAAAAAAAAAAAAAAAAAAAAAAAAA
```

FIGURE 38

MRPGLSFLLALLFFLGQAAGDLGDVGPPIPSPGFSSFPGVDSSSSFSSSSRSGSSSSRSLGS
GGSVSQLFSNFTGSVDDRGTCQCSVSLPDTTFPVDRVERLEFTAHVLSQKFEKELSKVREYV
QLISVYEKKLLNLTVRIDIMEKDTISYTELDFELIKVEVKEMEKLVIQLKESFGGSSEIVDQ
LEVEIRNMTLLVEKLETLDKNNVLAIRREIVALKTKLKECEASKDQNTPVVHPPPTPGSCGH
GGVVNISKPSVVQLNWRGFSYLYGAWGRDYSPQHPNKGLYWVAPLNTDGRLLEYYRLYNTLD
DLLLYINARELRITYGQGSGTAVYNNNMYVNMYNTGNIARVNLTTNTIAVTQTLPNAAYNNR
FSYANVAWQDIDFAVDENGLWVIYSTEASTGNMVISKLNDTTLQVLNTWYTKQYKPSASNAF
MVCGVLYATRTMNTRTEEIFYYYDTNTGKEGKLDIVMHKMQEKVQSINYNPFDQKLYVYNDG
YLLNYDLSVLQKPQ

FIGURE 39

```
GCTCTGAAGACCAAGCTGAAAGAGTGTGAGGCCTCTAAAGATCAAACACCCCTGTCGTCCAC
CCTCCTCCCACTCCAGGGAGCTGTGGTCATGGTGGTGTGGTGAACATCAGCAAACCGTCTGT
GGTTCAGCTCAACTGGAGAGGGTTTTCTTATCTATATGGTGCTTGGGGTAGGGATTACTCTC
CCCAGCATCCAAACAAAGGNATGTATTGGGNGGCGCCATTGAATACAGATGGGAGACTGTTG
GAGTATTATAGACTGTACAACCCACTGGATGATTTGCTATTGTATATAAATGCTCGAGAGTT
GCGGATCACCTATGGCCAAGGTAGTGGTACAGCAGTTTACAACAACAACATGTACGTCAACA
TGTACAACACCGGGNATATTGCCAGAGTTAACCTGACC
```

FIGURE 40

```
TCTCGCAGATAGTAAATAATCTCGGAAAGGCGAGAAAGAAGCTGTCTCCATCTTGTCTGTAT
CCGCTGCTCTTGTGACGTTGTGGAGATGGGGAGCGTCCTGGGGCTGTGCTCCATGGCGAGCT
GGATACCATGTTTGTGTGGAAGTGCCCCGTGTTTGCTATGCCGATGCTGTCCTAGTGGAAAC
AACTCCACTGTAACTAGATTGATCTATGCACTTTTCTTGCTTGTTGGAGTATGTGTAGCTTG
TGTAATGTTGATACCAGGAATGGAAGAACAACTGAATAAGATTCCTGGATTTTGTGAGAATG
AGAAAGGTGTTGTCCCTTGTAACATTTTGGTTGGCTATAAAGCTGTATATCGTTTGTGCTTT
GGTTTGGCTATGTTCTATCTTCTTCTCTCTTTACTAATGATCAAAGTGAAGAGTAGCAGTGA
TCCTAGAGCTGCAGTGCACAATGGATTTTGGTTCTTTAAATTTGCTGCAGCAATTGCAATTA
TTATTGGGGCATTCTTCATTCCAGAAGGAACTTTTACAACTGTGTGGTTTTATGTAGGCATG
GCAGGTGCCTTTTGTTTCATCCTCATACAACTAGTCTTACTTATTGATTTTGCACATTCATG
GAATGAATCGTGGGTTGAAAAAATGGAAGAAGGGAACTCGAGATGTTGGTATGCAGCCTTGT
TATCAGCTACAGCTCTGAATTATCTGCTGTCTTTAGTTGCTATCGTCCTGTTCTTTGTCTAC
TACACTCATCCAGCCAGTTGTTCAGAAAACAAGGCGTTCATCAGTGTCAACATGCTCCTCTG
CGTTGGTGCTTCTGTAATGTCTATACTGCCAAAAATCCAAGAATCACAACCAAGATCTGGTT
TGTTACAGTCTTCAGTAATTACAGTCTACACAATGTATTTGACATGGTCAGCTATGACCAAT
GAACCAGAAACAAATTGCAACCCAAGTCTACTAAGCATAATTGGCTACAATACAACAAGCAC
TGTCCCAAAGGAAGGGCAGTCAGTCCAGTGGTGGCATGCTCAAGGAATTATAGGACTAATTC
TCTTTTTGTTGTGTATTTTATTCCAGCATCCGTACTTCAAACAATAGTCAGGTTAATAAA
CTGACTCTAACAAGTGATGAATCTACATTAATAGAAGATGGTGGAGCTAGAAGTGATGGATC
ACTGGAGGATGGGGACGATGTTCACCGAGCTGTAGATAATGAAAGGGATGGTGTCACTTACA
GTTATTCCTTCTTTCACTTCATGCTTTTCCTGGCTTCACTTTATATCATGATGACCCTTACC
AACTGGTCCAGGTATGAACCCTCTCGTGAGATGAAAAGTCAGTGGACAGCTGTCTGGGTGAA
AATCTCTTCCAGTTGGATTGGCATCGTGCTGTATGTTTGGACACTCGTGGCACCACTTGTTC
TTACAAATCGTGATTTTGACTGAGTGAGACTTCTAGCATGAAAGTCCCACTTTGATTATTGC
TTATTTGAAAACAGTATTCCCAACTTTTGTAAAGTTGTGTATGTTTTTGCTTCCCATGTAAC
TTCTCCAGTGTTCTGGCATGAATTAGATTTTACTGCTTGTCATTTTGTTATTTTCTTACCAA
GTGCATTGATATGTGAAGTAGAATGAATTGCAGAGGAAAGTTTTATGAATATGGTGATGAGT
TAGTAAAAGTGGCCATTATTGGGCTTATTCTCTGCTCTATAGTTGTGAAATGAAGAGTAAAA
ACAAATTTGTTTGACTATTTTAAAATTATATTAGACCTTAAGCTGTTTTAGCAAGCATTAAA
GCAAATGTATGGCTGCCTTTTGAAATATTTGATGTGTTGCCTGGCAGGATACTGCAAAGAAC
ATGGTTTATTTTAAAATTTATAAACAAGTCACTTAAATGCCAGTTGTCTGAAAAATCTTATA
AGGTTTTACCCTTGATACGGAATTTACACAGGTAGGGAGTGTTTAGTGGACAATAGTGTAGG
TTATGGATGGAGGTGTCGGTACTAAATTGAATAACGAGTAAATAATCTTACTTGGGTAGAGA
TGGCCTTTTGCCAACAAAGTGAACTGTTTTGGTTGTTTTAAACTCATGAAGTATGGGTTCAGT
GGAAATGTTTGGAACTCTGAAGGATTTAGACAAGGTTTTGAAAGGATAATCATGGGTTAGA
AGGAAGTGTTTTGAAAGTCACTTTGAAAGTTAGTTTTGGGCCCAGCACGGTAGCTCACCCTT
GGTAATCCCAGCACTTTGGGAGCTTAAGTGGGTAGGATTACTTGAGCCCAGGAATTCAGACCA
GCTTGGCACATGGTGAACCTGTTCTATAAAAATAATCTGGCTTTGAGCATATGCCTGTGGTC
CAGCACTGAGAGGCTAGTGAAGATTGCTGAGCCCAGAGCCAAAGGTTGCAGTGAGCAAGTCA
CGTCACTGCACTCTAGCTGGCACAGAGTAAGCCAAAAAAATATATATATATTGAAATCAAGG
AGGCAAAATTTTGACAGGGAAGGAAGTAACTGCAAAACCACTAGGCTTTAGTAGGTACTTAT
ATAAAATCTAGTCCAGTTCTCTCATTTAAAAAAATGAAGACACTGAAATACAGACTTAAATA
GCTCAGATAGCTAATTAGGAAATTTCAAGTTGGCCAATAATAGCATTCTCTCTGACATTTAA
AAATAATTTCTATTCAAAATACATGCATATTGATTTACACCTCATACTGTGATAATTAATGT
GATGTGGATTGCTGGTGTCCAGCATGACCCATAAACAGGTCAGAAGAATGATGGAATGTTTT
AGAATAAACTCCTGCTTATAGTATACTACACAGTTCAAAAGATGTTTAAAATGCTTTTGTAT
TTACTGCCATGTAATTGAAATATATAGATTATTGTAACCTTTCAACCTGAAAATCAAGCAGT
ATGAGAGTTTAGTTATTTGTATGTGTCACTAGTGTCTAATGAAGCTTTTAAAATCTACAATT
TCTTCTTTAAAAATATTTATTAATGTGAATGGAATATAACAATTCAGCTTAATTCCCCAACC
TTATTCTGTGTGTAGACATTGTATTCCACAATTTTGAATGGCTGTGTTTTACCTCTAAATAA
ATGAATTCAGAGAAAAAAAAAAAAAAA
```

FIGURE 41

MGSVLGLCSMASWIPCLCGSAPCLLCRCCPSGNNSTVTRLIYALFLLVGVCVACVMLIPGME
EQLNKIPGFCENEKGVVPCNILVGYKAVYRLCFGLAMFYLLLSLLMIKVKSSSDPRAAVHNG
FWFFKFAAAIAIIIGAFFIPEGTFTTVWFYVGMAGAFCFILIQLVLLIDFAHSWNESWVEKM
EEGNSRCWYAALLSATALNYLLSLVAIVLFFVYYTHPASCSENKAFISVNMLLCVGASVMSI
LPKIQESQPRSGLLQSSVITVYTMYLTWSAMTNEPETNCNPSLLSIIGYNTTSTVPKEGQSV
QWWHAQGIIGLILFLLCVFYSSIRTSNNSQVNKLTLTSDESTLIEDGGARSDGSLEDGDDVH
RAVDNERDGVTYSYSFFHFMLFLASLYIMMTLTNWSRYEPSREMKSQWTAVWVKISSSWIGI
VLYVWTLVAPLVLTNRDFD

FIGURE 42

```
GCGAGAAAGAAGCTGTCTCCATCTTGTCTGTATCCCGCTGCTTCTTGNGACGTTGTGGAGAT
GGGGAGCGTCCCTGGGGCTGTGCTCCATGGCGAGCTGGATACCATGTTTGTGTGGAAGTGCC
CCGTGTTTGCTATGCCGATGCTGTCCTAGTGGAAACAANTCCACTGTAACTAGATTGATCTA
TGCACTTTTCTTGCTTGTTGGAGTATGTGTAGCTTGTGTAATGTTGATACCAGGAATGGAAG
AACAACTGAATAAGATTCCTGGATTTTGTGAGAATGAGAAAGGTGTTGTCCCTTGTAACATT
TTGGTTGGCTATAAAGCTGTATATCGTTTGTGCTTTGGTTTGGCTATGTTCTATCTTCTTCT
CTCTTTACTAATGATCAAAGTGAAGAGTAGCAGTGATCCTAGAGCTGCAGTGCACAATGGAT
TTTGGTTCTTTAAATTTGCTGCAGCAATTGCAATTATTATTGGGGC
```

FIGURE 43

```
GTTATTGTGAACTTTGTGGAGATGGGAGGTCNTGGGGCTGTGTTCCATGGCGAGCTGGATAC
CANGTTTGTGTGGAAGTGCCCCGTGTTTGNTATGCCGATGCTGTCCTAGTGGAAACAANTCC
ACTGTAATTAGATTGATNTATGCACTTTTNTTGCTTGTTGGAGTANGTGTAGCTTGTGTAAT
GTTGATACCAGGAATGGAAGAACAACTGAATAAGATTCCTGGATTTTGTGAGAATGAGAAAG
GTGTTGTCCCTTGTAACATTTTGGTTGGCTATAAAGCTGTATATNGTTTGTGCTTTGGTTTG
GCTANGTTCTATNTTCTTCTCTCTTTACTAATGATCAAAGTGAAGAGTAGCAGTGATCCTAG
AGCTGCAGTGCACAATGGATTTTGGTTTTTTAAATTTGCTGCAGCAATTGCAATTATTATTG
GGGC
```

FIGURE 44

```
AAGAAGCTGTCTCCATCTTGTCTGTATCCGCTGCTCTTGTGAACGTTNTGGAGATGGGGAGC
GTCCTTGGGGTTGTGCTCCATGGCGAGCTGGATACCATGTTTGTGTGGAAGTGCCCCGTGTT
TGCTATGCCGATGCTGTCCTAGTGGAAACAACTCCACTGTAACTAGATTGATCTATGCACTT
TTCTTGCTTGTTGGAGTATGTGTAGCTTGTGTAATGTTGATACCAGGAATGGAAGAACAACT
GAATAAGATTCCTGGATTTTGTGAGAATGAGAAAGGTGTTGTCCCTTGTAACATTTTGGTTG
GCTATAAAGCTGTATATCGTTTGTGCTTTGGTTTGGCTATGTTCTATCTTCTTCTCTCTTTA
CTAATGATCAAAGTGAAGAGTAGCAGTGATCCTAGAGCTGCAGTGCACAATGGATTTTGGTT
CTTTAAATTTGCTGCAGCAATTGCAATTATTATTGGGGC
```

FIGURE 45

```
GCTGTCCTTAGTGGAAACAANTCCAACTTGTAACTTGGATTGATCTATGCACTTTTTCCTTG
CTTGTTGGAGTATGTGTAGCTTTGTGTAATGTTGTTCCCAGGATTGGANGAACAACTGAATA
AGATTCCTGGATTTTTGTGAGAATGAGAAAGGTGTTGTCCCCTTGTAACATTTTTGGTTGGC
TATAAAGCTGTATATCGTTTGTGCTTTGGTTTGGCTATGTTCTATCTTCTTCTCTCTTTACT
AATGATCAAAGTGAAGAGTAGCAGTGATCCTAGAGCTGCAGTGCACAATGGATTTTGGTTCT
TTAAATTTGCTGCAGCAATTGCAATTATTATTGGGGCATTCTTCATTCCAGAAGGAACTTTT
ACAACTGTGTGGTTTTATGTAGGCATGGCAGGTGCCTTTTGTTTCATCCTCATACAACTAGT
CTTACTTATTGATTTTGCACATTCATGGAATGAATCGTGGGTTGAAAAAATGGAAGAAGGGA
ACTCGAGATGTTGGTATGCAGCCTTGTTATCAGCTACAGCTCTGAATTATCTGCTGTCTTTA
GTTGCTATCGTCCTGTTCTTTGTCTACTACACTCATCCAGCCAGTTGTTCAGAAAACAAGGC
GTTCATCAGTGTCAACATGCTCCTCTGCGTTGGTGCTTCTGTAATG
```

FIGURE 46

```
CTCGGGCGCGCACAGGCAGCTCGGTTTGCCCTGCGATTCAGCTGCGGGTCGCGGCCGGCGCCGGCCTCTCCAAT
GGCAAATGTGTGTGGCTGGAGGCGAGCGCGAGGCTTTCGGCAAAGGCAGTCGAGTGTTTGCAGACCGGGGCGAG
TCCTGTGAAAGCAGATAAAAGAAAACATTTATTAACGTGTCATTACGAGGGGAGCGCCCGGCCGGGGCTGTCGC
ACTCCCCGCGGAACATTTGGCTCCCTCCAGCTCCGAGAGAGGAGAAGAAGAAAGCGGAAAAGAGGCAGATTCAC
GTCGTTTCCAGCCAAGTGGACCTGATCGATGGCCCTCCTGAATTTATCACGATATTTGATTTATTAGCGATGCC
CCCTGGTTTGTGTGTTACGCACACACACGTGCACACAAGGCTCTGGCTCGCTTCCCTCCCTCGTTTCCAGCTCC
TGGGCGAATCCCACATCTGTTTCAACTCTCCGCCGAGGGCGAGCAGGAGCGAGAGTGTGTCGAATCTGCGAGTG
AAGAGGGACGAGGGAAAAGAAACAAAGCCACAGACGCAACTTGAGACTCCCGCATCCCAAAAGAAGCACCAGAT
CAGCAAAAAAGAAGATGGGCCCCCCGAGCCTCGTGCTGTGCTTGCTGTCCGCAACTGTGTTCTCCCTGCTGGG
TGGAAGCTCGGCCTTCCTGTCGCACCACCGCCTGAAAGGCAGGTTTCAGAGGGACCGCAGGAACATCCGCCCCA
ACATCATCCTGGTGCTGACGGACGACCAGGATGTGGAGCTGGGTTCCATGCAGGTGATGAACAAGACCCGGCGC
ATCATGGAGCAGGGCGGGGCGCACTTCATCAACGCCTTCGTGACCACACCCATGTGCTGCCCCTCACGCTCCTC
CATCCTCACTGGCAAGTACGTCCACAACCACAACACCTACACCAACAATGAGAACTGCTCCTCGCCCTCCTGGC
AGGCACAGCACGAGAGCCGCACCTTTGCCGTGTACCTCAATAGCACTGGCTACCGGACAGCTTTCTTCGGGAAG
TATCTTAATGAATACAACGGCTCCTACGTGCCACCCGGCTGGAAGGAGTGGGTCGGACTCCTTAAAAACTCCCG
CTTTTATAACTACACGCTGTGTCGGAACGGGGTGAAAGAGAAGCACGGCTCCGACTACTCCAAGGATTACCTCA
CAGACCTCATCACCAATGACAGCGTGAGCTTCTTCCGCACGTCCAAGAAGATGTACCCGCACAGGCCAGTCCTC
ATGGTCATCAGCCATGCAGCCCCCCACGGCCCTGAGGATTCAGCCCCACAATATTCACGCCTCTTCCCAAACGC
ATCTCAGCACATCACGCCGAGCTACAACTACGCGCCCAACCCGGACAAACACTGGATCATGCGCTACACGGGGC
CCATGAAGCCCATCCACATGGAATTCACCAACATGCTCCAGCGGAAGCGCTTGCAGACCCTCATGTCGGTGGAC
GACTCCATGGAGACGATTTACAACATGCTGGTTGAGACGGGCGAGCTGGACAACACGTACATCGTATACACCGC
CGACCACGGTTACCACATCGGCCAGTTTGGCCTGGTGAAAGGGAAATCCATGCCATATGAGTTTGACATCAGGG
TCCCGTTCTACGTGAGGGGCCCCAACGTGGAAGCCGGCTGTCTGAATCCCCACATCGTCCTCAACATTGACCTG
GCCCCCACCATCCTGGACATTGCAGGCCTGGACATACCTGCGGATATGGACGGGAAATCCATCCTCAAGCTGCT
GGACACGGAGCGGCCGGTGAATCGGTTTCACTTGAAAAAGAAGATGAGGGTCTGGCGGGACTCCTTCTTGGTGG
AGAGAGGCAAGCTGCTACACAAGAGAGACAATGACAAGGTGGACGCCCAGGAGGAGAACTTTCTGCCCAAGTAC
CAGCGTGTGAAGGACCTGTGTCAGCGTGCTGAGTACCAGACGGCGTGTGAGCAGCTGGGACAGAAGTGGCAGTG
TGTGGAGGACGCCACGGGGAAGCTGAAGCTGCATAAGTGCAAGGGCCCCATGCGGCTGGGCGGCAGCAGAGCCC
TCTCCAACCTCGTGCCCAAGTACTACGGGCAGGGCAGCGAGGCCTGCACCTGTGACAGCGGGGACTACAAGCTC
AGCCTGGCCGGACGCCGGAAAAAACTCTTCAAGAAGAAGTACAAGGCCAGCTATGTCCGCAGTCGCTCCATCCG
CTCAGTGGCCATCGAGGTGGACGGCAGGGTGTACCACGTAGGCCTGGGTGATGCCGCCCAGCCCCGAAACCTCA
CCAAGCGGCACTGGCCAGGGGCCCCTGAGGACCAAGATGACAAGGATGGTGGGGACTTCAGTGGCACTGGAGGC
CTTCCCGACTACTCAGCCGCCAACCCCATTAAAGTGACCATCGGTGCTACATCCTAGAGAACGACACAGTCCA
GTGTGACCTGGACCTGTACAAGTCCCTGCAGGCCTGGAAAGACCACAAGCTGCACATCGACCACGAGATTGAAA
CCCTGCAGAACAAAATTAAGAACCTGAGGGAAGTCCGAGGTCACCTGAAGAAAAAGCGGCCAGAAGAATGTGAC
TGTCACAAAATCAGCTACCACACCCAGCACAAAGGCCGCCTCAAGCACAGAGGCTCCAGTCTGCATCCTTTCAG
GAAGGGCCTGCAAGAGAAGGACAAGGTGTGGCTGTTGCGGGAGCAGAAGCGCAAGAAGAAACTCCGCAAGCTGC
TCAAGCGCCTGCAGAACAACGACACGTGCAGCATGCCAGGCCTCACGTGCTTCACCCACGACAACCAGCACTGG
CAGACGGCGCCTTTCTGGACACTGGGGCCTTTCTGTGCCTGCACCAGCGCCAACAATAACACGTACTGGTGCAT
GAGGACCATCAATGAGACTCACAATTTCCTCTTCTGTGAATTTGCAACTGGCTTCCTAGAGTACTTTGATCTCA
ACACAGACCCCTACCAGCTGATGAATGCAGTGAACACACTGGACAGGGATGTCCTCAACCAGCTACACGTACAG
CTCATGGAGCTGAGGAGCTGCAAGGGTTACAAGCAGTGTAACCCCCGGACTCGAAACATGGACCTGGATGGAGG
AAGCTATGAGCAATACAGGCAGTTTCAGCGTCGAAAGTGGCCAGAAATGAACAGACCTTCTTCCAAATCACTGG
GACAACTGTGGGAAGGCTGGAAGGTTAAGAAACAACAGAGGTGGACCTCCAAAAACATAGAGGCATCACCTGA
CTGCACAGGCAATGAAAAACCATGTGGGTGATTTCCAGCAGACCTGTGCTATTGGCCAGGAGCCCTGAGAAAGC
AAGCACGCACTCTCAGTCAACATGACAGATTCTGGAGGATAACCAGCAGGAGCAGAGATAACTTCAGGAAGTCC
ATTTTTGCCCCTGCTTTTGCTTTGGATTATACCTCACCAGCTGCACAAATGCATTTTTTCGTATCAAAAAGTC
ACCACTAACCCTCCCCCAGAAGCTCACAAAGGAAAACGGAGAGAGCGAGCGAGAGAGATTTCCTTGGAAATTTC
TCCCAAGGGCGAAAGTCATTGGAATTTTTAAATCATAGGGGAAAAGCAGTCCTGTTCTAAATCCTCTTATTCTT
TTGGTTTGTCACAAAGAAGGAACTAAGAAGCAGGACAGAGGCAACGTGGAGAGGCTGAAAACAGTGCAGAGACG
TTTGACAATGAGTCAGTAGCACAAAAGAGATGACATTTACCTAGCACTATAAACCCTGGTTGCCTCTGAAGAAA
CTGCCTTCATTGTATATATGTGACTATTTACATGTAATCAACATGGGAACTTTTAGGGGAACCTAATAAGAAAT
CCCAATTTTCAGGAGTGGTGGTGTCAATAAACGCTCTGTGGCCAGTGTAAAAGAAAAA
```

FIGURE 47

MGPPSLVLCLLSATVFSLLGGSSAFLSHHRLKGRFQRDRRNIRPNIILVLTDDQDVELGSMQ
VMNKTRRIMEQGGAHFINAFVTTPMCCPSRSSILTGKYVHNHNTYTNNENCSSPSWQAQHES
RTFAVYLNSTGYRTAFFGKYLNEYNGSYVPPGWKEWVGLLKNSRFYNYTLCRNGVKEKHGSD
YSKDYLTDLITNDSVSFFRTSKKMYPHRPVLMVISHAAPHGPEDSAPQYSRLFPNASQHITP
SYNYAPNPDKHWIMRYTGPMKPIHMEFTNMLQRKRLQTLMSVDDSMETIYNMLVETGELDNT
YIVYTADHGYHIGQFGLVKGKSMPYEFDIRVPFYVRGPNVEAGCLNPHIVLNIDLAPTILDI
AGLDIPADMDGKSILKLLDTERPVNRFHLKKKMRVWRDSFLVERGKLLHKRDNDKVDAQEEN
FLPKYQRVKDLCQRAEYQTACEQLGQKWQCVEDATGKLKLHKCKGPMRLGGSRALSNLVPKY
YGQGSEACTCDSGDYKLSLAGRRKKLFKKKYKASYVRSRSIRSVAIEVDGRVYHVGLGDAAQ
PRNLTKRHWPGAPEDQDDKDGGDFSGTGGLPDYSAANPIKVTHRCYILENDTVQCDLDLYKS
LQAWKDHKLHIDHEIETLQNKIKNLREVRGHLKKKRPEECDCHKISYHTQHKGRLKHRGSSL
HPFRKGLQEKDKVWLLREQKRKKKLRKLLKRLQNNDTCSMPGLTCFTHDNQHWQTAPFWTLG
PFCACTSANNNTYWCMRTINETHNFLFCEFATGFLEYFDLNTDPYQLMNAVNTLDRDVLNQL
HVQLMELRSCKGYKQCNPRTRNMDLDGGSYEQYRQFQRRKWPEMKRPSSKSLGQLWEGWEG

FIGURE 48

AACAAAGTTCAGTGACTGAGAGGGCTGAGCGGAGGCTGCTGAAGGGGAGAAAGGAGTGAGGA
GCTGCTGGGCAGAGAGGGACTGTCCGGCTCCCAGATGCTGGGCCTCCTGGGGAGCACAGCCC
TCGTGGGATGGATCACAGGTGCTGCTGTGGCGGTCCTGCTGCTGCTGCTGCTGGCCACC
TGCCTTTTCCACGGACGGCAGGACTGTGACGTGGAGAGGAACCGTACAGCTGCAGGGGAAA
CCGAGTCCGCCGGGCCCAGCCTTGGCCCTTCCGGCGGCGGGGCCACCTGGGAATCTTTCACC
ATCACCGTCATCCTGGCCACGTATCTCATGTGCCGAATGTGGGCCTCCACCACCACCACCAC
CCCCGCCACACCCCTCACCACCTCCACCACCACCACCACCCCCACCGCCACCATCCCCGCCA
CGCTCGCTGAGGCTGCTGTCGCCGGTGCCTGTGGACAGCAGCTGCCCCTGCCCTCCCATCTG
TTCCCAGGACAAGTGGACCCCATGTTTCCATGTGGAAGGATGCATCTCTGGGGTGAACGAGG
GGAACAATAGACTGGGGCTTGCTCCAGCTGCATTTGCATGGCATGCCCCAGTGTACTATGGC
AGCAGAGAATGGAGGAACACTGGGTCTGCAGTGCTGAAGGGTTTGGGGAGTGGAGAGCAAGG
GTGCTCTTTCGGGGCTGGACAGCCCGTCTTGTGACAGTGACTCCCAGTGAGCCCCAGAAATG
ACAAGCGTGTCTTGGCAGAGCCAGCACACAAGTGGATGTGAAGTGCCCGTCTTGACCTCCTC
ATCAGGCTGCTGCAGGCCTCTGGCGGGCAGGGCACTGGGAGAGGCCCTGAGAATGTCCTTTT
GGTTTGGAGAAGGCAGTGTGAGGCTGCACAGTCAATTCATCGGTGCCTTAGTCCAAGAAAAT
AAAAACCACTAAGAAGCTTTAAAAAAAAAAAAAAAAAAAAAA

FIGURE 49

```
MLGLLGSTALVGWITGAAVAVLLLLLLLATCLFHGRQDCDVERNRTAAGGNRVRRAQPWPFR
RRGHLGIFHHHRHPGHVSHVPNVGLHHHHHPRHTPHHLHHHHHPHRHHPRHAR
```

FIGURE 50

GGCGGCTGCTGAGCTGCCTTGAGGTGCAGTGTTGGGGATCCAGAGCCATGTCGGACCTGCTA
CTACTGGGCCTGATTGGGGGCCTGACTCTCTTACTGCTGCTGACGCTGCTGGCCTTTGCCGG
GTACTCAGGGCTACTGGCTGGGGTGGAAGTGAGTGCTGGGTCACCCCCCATCCGCAACGTCA
CTGTGGCCTACAAGTTCCACATGGGGCTCTATGGTGAGACTGGGCGGCTTTTCACTGAGAGC
TGCAGCATCTCTCCCAAGCTCCGCTCCATCGCTGTCTACTATGACAACCCCCACATGGTGCC
CCCTGATAAGTGCCGATGTGCCGTGGGCAGCATCCTGAGTGAAGGTGAGGAATCGCCCTCCC
CTGAGCTCATCGACCTCTACCAGAAATTTGGCTTCAAGGTGTTCTCCTTCCCGGCACCCAGC
CATGTGGTGACAGCCACCTTCCCCTACACCACCATTCTGTCCATCTGGCTGGCTACCCGCCG
TGTCCATCCTGCCTTGGACACCTACATCAAGGAGCGGAAGCTGTGTGCCTATCCTCGGCTGG
AGATCTACCAGGAAGACCAGATCCATTTCATGTGCCCACTGGCACGGCAGGGAGACTTCTAT
GTGCCTGAGATGAAGGAGACAGAGTGGAAATGGCGGGGGCTTGTGGAGGCCATTGACACCCA
GGTGGATGGCACAGGAGCTGACACAATGAGTGACACGAGTTCTGTAAGCTTGGAAGTGAGCC
CTGGCAGCCGGGAGACTTCAGCTGCCACACTGTCACCTGGGGCGAGCAGCCGTGGCTGGGAT
GACGGTGACACCCGCAGCGAGCACAGCTACAGCGAGTCAGGTGCCAGCGGCTCCTCTTTTGA
GGAGCTGGACTTGGAGGGCGAGGGGCCCTTAGGGGAGTCACGGCTGGACCCTGGGACTGAGC
CCCTGGGGACTACCAAGTGGCTCTGGGAGCCCACTGCCCCTGAGAAGGGCAAGGAGTAACCC
ATGGCCTGCACCCTCCTGCAGTGCAGTTGCTGAGGAACTGAGCAGACTCTCCAGCAGACTCT
CCAGCCCTCTTCCTCCTTCCTCTGGGGGAGGAGGGGTTCCTGAGGGACCTGACTTCCCCTGC
TCCAGGCCTCTTGCTAAGCCTTCTCCTCACTGCCCTTTAGGCTCCCAGGGCCAGAGGAGCCA
GGGACTATTTTCTGCACCAGCCCCCAGGGCTGCCGCCCCTGTTGTGTCTTTTTTTCAGACTC
ACAGTGGAGCTTCCAGGACCCAGAATAAAGCCAATGATTTACTTGTTTCACCTGGAAAAAAA
AAAAAAAAAA

FIGURE 51

MSDLLLLGLIGGLTLLLLLTLLAFAGYSGLLAGVEVSAGSPPIRNVTVAYKFHMGLYGETGR
LFTESCSISPKLRSIAVYYDNPHMVPPDKCRCAVGSILSEGEESPSPELIDLYQKFGFKVFS
FPAPSHVVTATFPYTTILSIWLATRRVHPALDTYIKERKLCAYPRLEIYQEDQIHFMCPLAR
QGDFYVPEMKETEWKWRGLVEAIDTQVDGTGADTMSDTSSVSLEVSPGSRETSAATLSPGAS
SRGWDDGDTRSEHSYSESGASGSSFEELDLEGEGPLGESRLDPGTEPLGTTKWLWEPTAPEK
GKE

FIGURE 52

CCGCGGGAACGCTGTCCTGGCTGCCGCCACCCGAACAGCCTGTCCTGGTGCCCCGGCTCCCT
GCCCCGCGCCCAGTCATGACCCTGCGCCCCTCACTCCTCCCGCTCCATCTGCTGCTGCTGCT
GCTGCTCAGTGCGGCGGTGTGCCGGGCTGAGGCTGGGCTCGAAACCGAAAGTCCCGTCCGGA
CCCTCCAAGTGGAGACCCTGGTGGAGCCCCAGAACCATGTGCCGAGCCCGCTGCTTTTGGA
GACACGCTTCACATACACTACACGGGAAGCTTGGTAGATGGACGTATTATTGACACCTCCCT
GACCAGAGACCCTCTGGTTATAGAACTTGGCCAAAAGCAGGTGATTCCAGGTCTGGAGCAGA
GTCTTCTCGACATGTGTGTGGGAGAGAAGCGAAGGGCAATCATTCCTTCTCACTTGGCCTAT
GGAAAACGGGGATTTCCACCATCTGTCCCAGCGGATGCAGTGGTGCAGTATGACGTGGAGCT
GATTGCACTAATCCGAGCCAACTACTGGCTAAAGCTGGTGAAGGGCATTTTGCCTCTGGTAG
GGATGGCCATGGTGCCAGCCCTCCTGGGCCTCATTGGGTATCACCTATACAGAAAGGCCAAT
AGACCCAAAGTCTCCAAAAAGAAGCTCAAGGAAGAGAAACGAAACAAGAGCAAAAAGAAA**TA
A**TAAATAATAAATTTTAAAAAACTTAAAAAAAAAAAAAAAAAA

FIGURE 53

MTLRPSLLPLHLLLLLLLSAAVCRAEAGLETESPVRTLQVETLVEPPEPCAEPAAFGDTLHI

HYTGSLVDGRIIDTSLTRDPLVIELGQKQVIPGLEQSLLDMCVGEKRRAIIPSHLAYGKRGF

PPSVPADAVVQYDVELIALIRANYWLKLVKGILPLVGMAMVPALLGLIGYHLYRKANRPKVS

KKKLKEEKRNKSKKK

FIGURE 54

CCCGGGAACGTGTTCCTGGCTGCCGCACCCGAACAGCCTGTCCTGGTGCCCCGGCTCCCTGC
CCCGCGCCCAGTCATGACCCTGCGCCCCTCACTCCTCCCGCTCCATCTGCTGCTGCTGCTGC
TGCTCAGTGCGGCGGTGTGCCGGGCTGAGGCTGGGCTCGAAACCGAAAGTCCCGTCCGGACC
CTCCAAGTGGAGACCCTGGTGGAGCCCCAGAACCATGTGCCGAGCCCGCTGCTTTTGGAGA
CACGCTTCACATACACTACACGGGAAGCTTGGTAGATGGACGTATTATTGACACCTCCCTGA
CCAGAGACCCTCTGGTTATAGAACTTGGCCAAAAGCAGGTGATTCCAGGTCTGGAGCAGAGT
CTTCTCGACATGTGTGTGGGAGAGAAGCGAAGGGCAATCATTCCTTCTCACTTGGCCTATGG
AAAACGGGGATTTCCACCATCTGTCCCAGCGGATGCAGTGGTGCAGTATGACGTGGAGCTGA
TTGCACTAATCCGAGCCAACTACTGGCTAAAGCTGGTGAAGGGCATTTTGCCTCTGGTAGGG
ATGGCCATGGTGCCACCCTCCTGGGCCTCATTGGGTATCACCTATACAGAAAGGCCAATAGA
CCCAAAGTCTCCAAAAAGAAGCTCAAGGAAGAGAAACGAAACAAGAGCAAAAAGAAATAATA
AATAATAAATTTTAAAAAACTTA

FIGURE 55

CCGAAAGTCCCGTCCGGACCCTCCAAGTGGAGACCCTGGTGGAGCCCCCAGAACCATGTGCC
GAGCCCGCTGCTTTTGGAGACACGCTTCACATACACTACACGGGAAGCTTGGTAGATGGACG
TATTATTGACACCTCCCTGACCAGAGACCCTCTGGTTATAGAACTTGGCCAAAAGCAGGTGA
TTCCAGGTCTGGAGCAGAGTCTTCTCGACATGTGTGTGGGAGAGAAGCGAAGGGCAATCATT
CCTTCTCACTTGGCCTATGGAAAACGGGGATTTCCACCATCTGTCCCAGCGGATGCAGTGGT
GCAGTATGACGTGGAGCTGATTGCACTAATCCGAGCCAACTACTGGCTAAAGCTGGTGAAGG
GCATTTTGCCTCTGGTAGGGATGGCCATGGTGCCAGCCCTCCTGGGCCTCATTGGGTATCAC
CTATACAGAAAGGCCAATAGACCCAAAGTCTCCAAAAAGAAGCTCAAGGAAGAGAAACGAAA
CAAGAGCAAAAGAAATAATAAATAATAAATTTTAAAAAACTTAAAA

FIGURE 56

```
CTGCTGCATCCGGGTGTCTGGAGGCTGTGGCCGTTTTGTTTTCTTGGCTAAAATCGGGGGAG
TGAGGCGGGCCGGCGCGGCGCGACACCGGGCTCCGGAACCACTGCACGACGGGGCTGGACTG
ACCTGAAAAAAATGTCTGGATTTCTAGAGGGCTTGAGATGCTCAGAATGCATTGACTGGGGG
GAAAAGCGCAATACTATTGCTTCCATTGCTGCTGGTGTACTATTTTTTACAGGCTGGTGGAT
TATCATAGATGCAGCTGTTATTTATCCCACCATGAAAGATTTCAACCACTCATACCATGCCT
GTGGTGTTATAGCAACCATAGCCTTCCTAATGATTAATGCAGTATCGAATGGACAAGTCCGA
GGTGATAGTTACAGTGAAGGTTGTCTGGGTCAAACAGGTGCTCGCATTTGGCTTTTCGTTGG
TTTCATGTTGGCCTTTGGATCTCTGATTGCATCTATGTGGATTCTTTTTGGAGGTTATGTTG
CTAAAGAAAAGACATAGTATACCCTGGAATTGCTGTATTTTTCCAGAATGCCTTCATCTTT
TTTGGAGGGCTGGTTTTTAAGTTTGGCCGCACTGAAGACTTATGGCAGTGAACACATCTGAT
TTCCCACAGCACAACAGCCCTGCATGGGTTTGTTTGTTTTTTACTGCTCACTCCCAACCTT
TTGTAATGCCATTTTCTAAACTTATTTCTGAGTGTAGTCTCAGCTTAAAGTTGTGTAATACT
AAAATCACGAGAACACCTAAACAACAACCAAAAATCTATTGTGGTATGCACTTGATTAACTT
ATAAAATGTTAGAGGAAACTTTCACATGAATAATTTTTGTCAAATTTTATCATGGTATAATT
TGTAAAAATAAAAGAAATTACAAAAGAAATTATGGATTTGTCAATGTAAGTATTTGTCATA
TCTGAGGTCCAAAACCACAATGAAAGTGCTCTGAAGATTTAATGTGTTTATTCAAATGTGGT
CTCTTCTGTGTCAAATGTTAAATGAAATATAAACATTTTTAGTTTTTAAAATATTCCGTGG
TCAAAATTCTTCCTCACTATAATTGGTATTTACTTTTACCAAAAATTCTGTGAACATGTAAT
GTAACTGGCTTTTGAGGGTCTCCCAAGGGGTGAGTGGACGTGTTGGAAGAGAGAAGCACCAT
GGTCCAGCCACCAGGCTCCCTGTGTCCCTTCCATGGGAAGGTCTTCCGCTGTGCCTCTCATT
CCAAGGGCAGGAAGATGTGACTCAGCCATGACACGTGGTTCTGGTGGGATGCACAGTCACTC
CACATCCACCACTG
```

FIGURE 57

MSGFLEGLRCSECIDWGEKRNTIASIAAGVLFFTGWWIIIDAAVIYPTMKDFNHSYHACGVI
ATIAFLMINAVSNGQVRGDSYSEGCLGQTGARIWLFVGFMLAFGSLIASMWILFGGYVAKEK
DIVYPGIAVFFQNAFIFFGGLVFKFGRTEDLWQ

FIGURE 58

TTCTTGGCTAAAATCGGGGGAGTGAGGCGGGCCGGCGCGGCGCGACACCGGGCTCCGGAACC
ACTGCACGACGGGGCTGGACTGACCTGAAAAAAATGTCTGGATTTCTAGAGGGCTTGAGATG
CTCAGAATGCATTGACTGGGGGGAAAAGCGCAATACTATTGCTTCCATTGCTGCTGGTGTAC
TATTTTTTACAGGCTGGTGGATTATCATAGATGCAGCTGTTATTTATCCCACCATGAAAGAT
TTCAACCACTCATACCATGCCTGTGGTGTTATAGCAACCATAGCCTTCCTAATGATTAATGC
AGTATCGAATGGACAAGTCCGAGGTGATAGTTACAGTGAAGGTTGTCTGGGTCAAACAGGTG
CTCGCATTTGGCTTTTCGTTGGTTTCATGTTGGCCTTTGGATCTCTGATTGCATCTATGTGG
ATTCTTTTTGGAGGTTATGTTGCTAAAGAAAAGACATAGTATACCCTGGAATTGCTGTATT
TTTCCAGAATGCCTTCATCTTTTTTGGAGGGCTGGTTTTTAAGTTTGGC

FIGURE 59

TGGACGGACCTGAAAAAAATGTTTGGATTTNTAGAGGGNTTGAGATGTTCAGAATGCATGAC
TGGGGGAAAAGCGCAAATACTATTGCTTCCATTGCTGCTGGTGTANTATTTTTTACAGGCTG
GTGGATTATCATAGATGCAGNTGTTATTTATCCCACCATGAAAGATTTCAACCANTCATACC
ATGCCTGTGGTGTTATAGCAACCATAGCCTTCNTAATGATTAATGCAGTATCGAATGGACAA
GTCCGAGGTGATAGTTACAGTGAAGGTTGTTTGGGTCAAACAGGTGCTCGCATTTGGCTTTT
CGTTGGTTTCATGTTGGCCTTTGGATCTCTGATTGCATCTATGTGGATTCTTTTTGGAGGTT
ATGTTGCTAAAGAAAAAGACATAGTATACCCTGGAATTGNTGTATTTTTCCAGAATGCCTTC
ATCTTTTTTGGAGGGCTGGTTTTTAAGTTTGGCCGCACTGAAGANTTATGGCAGTG

FIGURE 60

```
GGACACCGGGTTCCGGACCAATGCANGACGGGGTGGANTGACCTGAAAAAAATGTTTGGATT
TTTAGAGGGCTTGAGATGNTCAGAATGCATTGACTGGGGGAAAAGCGCAATANTATTGCTTT
CCATTGCTGCTGGTGTACTATTTTTACAGGGTGGTGGATTATCATAGATGCAGCTGTTATT
TATCCCACCATGAAAGATTTNAACCACTCATACCATGCCTGTGGTGTTATAGCAACCATAGC
CTTCCTAATGATTAATGCAGTATCGAATGGACAAGTCCGAGGTGATAGTTACAGTGAAGGTT
GTTTGGGTCAAACAGGTGNTCGCATTTGGCTTTTCGTTGGTTTCATGTTGGCCTTTGGATTT
CTGATTGNATTCTATGCGGATTCTTCTTGGAGGTTATGTTGCTAAAGAAAAGACATAGTAT
ACCCTGGAATTNCTNTATTTTCCAGAATGCC
```

FIGURE 61

```
TAGAGGGCTTGAGATGCTCAGAATGCATTGACTGGGGGGAAAAGCGCAATANTATTGCTTCC
ATTGNTGNTGGTGTANTATTTTTTTACAGGCTGGTGGATTATNATAGATGCAGCTGTTATTT
ATCCCACCATGAAAGATTTNAACCANTCATACCATGCCTGTGGTGTTATAGCAACCATAGCC
TTCCTAATGATTAATGCAGTATNGAATGGACAAGTCCGAGGTGATAGTTACAGTGAAGGTTG
TTTGGGTCAAACAGGTGNTNGCATTTGGCTTTTNGTTGGTTTCATGTTGGCCTTTGGATCTN
TGATTGCATTTATGTGGATTNTTTTTGGAGGTTATGTTGCTAAAGNAAAAGACATAGTATAC
CCTGT
```

FIGURE 62

```
GGGAGGCTGTGNCCGTTTTGTTTTNTTGGCTAAAATCGGGGGAGTGAGGCGGCCCGGCGCGG
CGNGACACCGGGTTCCGGGAACCATTGCACGACGGGGTGGACTGACCTGAAAAAAATGTTTG
GATTTNTAGAGGGCTTGAGATGCTCAGAATGCATTGACTGGGGGGAAAAGCGCAATACTATT
GCTTCCATTGCTGCTGGTGTACTATTTTTTACAGGCTGGTGGATTATCATAGATGCAGCTGT
TATTTATCCCACCATGAAAGATTTCAACCACTCATACCATGCCTGTGGTGTTATAGCAACCA
TAGCCTTCCTAATGATTAATGCAGTATCGAATGGACAAGTCCGAGGTGATAGTTACAGTGAA
GGTTGTCTGGGTCAAACAGGTGCTCGCATTTGGCTTTTCGTTGGTTTCATGTTGGCCTTTGG
ATNTCTGATTGCATCTATGTGGATTCTTTTTGGAGGTTATGTTGCTAAAGAAAAGACATAG
TATACCCTGGAATTGCTGTATTTTTCCAGAATGCCTTCATNTTTTTGGAGGGCTG
```

FIGURE 63

```
CGACGCCGGCGTGATGTGGCTTCCGCTGGTGCTGCTCCTGGCTGTGCTGCTGCTGGCCGTCC
TCTGCAAAGTTTACTTGGGACTATTCTCTGGCAGCTCCCCGAATCCTTTCTCCGAAGATGTC
AAACGGCCCCCAGCGCCCCTGGTAACTGACAAGGAGGCCAGGAAGAAGGTTCTCAAACAAGC
TTTTTCAGCCAACCAAGTGCCGGAGAAGCTGGATGTGGTGGTAATTGGCAGTGGCTTTGGGG
GCCTGGCTGCAGCTGCAATTCTAGCTAAAGCTGGCAAGCGAGTCCTGGTGCTGGAACAACAT
ACCAAGGCAGGGGGCTGCTGTCATACCTTTGGAAAGAATGGCCTTGAATTTGACACAGGAAT
CCATTACATTGGGCGTATGGAAGAGGGCAGCATTGGCCGTTTTATCTTGGACCAGATCACTG
AAGGGCAGCTGGACTGGGCTCCCCTGTCCTCTCCTTTTGACATCATGGTACTGGAAGGGCCC
AATGGCCGAAAGGAGTACCCCATGTACAGTGGAGAGAAAGCCTACATTCAGGGCCTCAAGGA
GAAGTTTCCACAGGAGGAAGCTATCATTGACAAGTATATAAAGCTGGTTAAGGTGGTATCCA
GTGGAGCCCCTCATGCCATCCTGTTGAAATTCCTCCCATTGCCCGTGGTTCAGCTCCTCGAC
AGGTGTGGGCTGCTGACTCGTTTCTCTCCATTCCTTCAAGCATCCACCCAGAGCCTGGCTGA
GGTCCTGCAGCAGCTGGGGGCCTCCTCTGAGCTCCAGGCAGTACTCAGCTACATCTTCCCCA
CTTACGGTGTCACCCCCAACCACAGTGCCTTTTCCATGCACGCCCTGCTGGTCAACCACTAC
ATGAAAGGAGGCTTTTATCCCCGAGGGGGTTCCAGTGAAATTGCCTTCCACACCATCCCTGT
GATTCAGCGGGCTGGGGGCGCTGTCCTCACAAAGGCCACTGTGCAGAGTGTGTTGCTGGACT
CAGCTGGGAAAGCCTGTGGTGTCAGTGTGAAGAAGGGGCATGAGCTGGTGAACATCTATTGC
CCCATCGTGGTCTCCAACGCAGGACTGTTCAACACCTATGAACACCTACTGCCGGGGAACGC
CCGCTGCCTGCCAGGTGTGAAGCAGCAACTGGGGACGGTGCGGCCCGGCTTAGGCATGACCT
CTGTTTTCATCTGCCTGCGAGGCACCAAGGAAGACCTGCATCTGCCGTCCACCAACTACTAT
GTTTACTATGACACGGACATGGACCAGGCGATGGAGCGCTACGTCTCCATGCCCAGGGAAGA
GGCTGCGGAACACATCCCTCTTCTCTTCTTCGCTTTCCCATCAGCCAAAGATCCGACCTGGG
AGGACCGATTCCCAGGCCGGTCCACCATGATCATGCTCATACCCACTGCCTACGAGTGGTTT
GAGGAGTGGCAGGCGGAGCTGAAGGGAAAGCGGGGCAGTGACTATGAGACCTTCAAAAACTC
CTTTGTGGAAGCCTCTATGTCAGTGGTCCTGAAACTGTTCCCACAGCTGGAGGGGAAGGTGG
AGAGTGTGACTGCAGGATCCCCACTCACCAACCAGTTCTATCTGGCTGCTCCCGAGGTGCC
TGCTACGGGGCTGACCATGACCTGGGCCGCCTGCACCCTTGTGTGATGGCCTCCTTGAGGGC
CCAGAGCCCCATCCCCAACCTCTATCTGACAGGCCAGGATATCTTCACCTGTGGACTGGTCG
GGGCCCTGCAAGGTGCCCTGCTGTGCAGCGCCATCCTGAAGCGGAACTTGTACTCAGAC
CTTAAGAATCTTGATTCTAGGATCCGGGCACAGAAGAAAAAGAATTAGTTCCATCAGGGAGG
AGTCAGAGGAATTTGCCCAATGGCTGGGGCATCTCCCTTGACTTACCCATAATGTCTTTCTG
CATTAGTTCCTTGCACGTATAAAGCACTCTAATTTGGTTCTGATGCCTGAAGAGAGGCCTAG
TTTAAATCACAATTCCGAATCTGGGGCAATGGAATCACTGCTTCCAGCTGGGGCAGGTGAGA
TCTTTACGCCTTTTATAACATGCCATCCCTACTAATAGGATATTGACTTGGATAGCTTGATG
TCTCATGACGAGCGGCGCTCTGCATCCCTCACCCATGCCTCCTAACTCAGTGATCAAAGCGA
ATATTCCATCTGTGGATAGAACCCCTGGCAGTGTTGTCAGCTCAACCTGGTGGGTTCAGTTC
TGTCCTGAGGCTTCTGCTCTCATTCATTTAGTGCTACGCTGCACAGTTCTACACTGTCAAGG
GAAAAGGGAGACTAATGAGGCTTAACTCAAAACCTGGGCGTGGTTTTGGTTGCCATTCCATA
GGTTTGGAGAGCTCTAGATCTCTTTTGTGCTGGGTTCAGTGGCTCTTCAGGGGACAGGAAAT
GCCTGTGTCTGGCCAGTGTGGTTCTGGAGCTTTGGGGTAACAGCAGGATCCATCAGTTAGTA
GGGTGCATGTCAGATGATCATATCCAATTCATATGGAAGTCCCGGGTCTGTCTTCCTTATCA
TCGGGGTGGCAGCTGGTTCTCAATGTGCCAGCAGGGACTCAGTACCTGAGCCTCAATCAAGC
CTTATCCACCAAATACACAGGGAAGGTGATGCAGGGAAGGGTGACATCAGGAGTCAGGGCA
TGGACTGGTAAGATGAATACTTTGCTGGGCTGAAGCAGGCTGCAGGGCATTCCAGCCAAGGG
CACAGCAGGGGACAGTGCAGGGAGGTGTGGGGTAAGGGAGGGAAGTCACATCAGAAAAGGGA
AAGCCACGGAATGTGTGTGAAGCCCAGAAATGGCATTTGCAGTTAATTAGCACATGTGAGGG
TTAGACAGGTAGGTGAATGCAAGCTCAAGGTTTGGAAAAATGACTTTTCAGTTATGTCTTTG
GTATCAGACATACGAAAGGTCTCTTTGTAGTTCGTGTTAATGTAACATTAATAAATTTATTG
ATTCCATTGCTTTAAAAAAAAAAAAAAA
```

FIGURE 64

MWLPLVLLLAVLLLAVLCKVYLGLFSGSSPNPFSEDVKRPPAPLVTDKEARKKVLKQAFSAN
QVPEKLDVVVIGSGFGGLAAAAILAKAGKRVLVLEQHTKAGGCCHTFGKNGLEFDTGIHYIG
RMEEGSIGRFILDQITEGQLDWAPLSSPFDIMVLEGPNGRKEYPMYSGEKAYIQGLKEKFPQ
EEAIIDKYIKLVKVVSSGAPHAILLKFLPLPVVQLLDRCGLLTRFSPFLQASTQSLAEVLQQ
LGASSELQAVLSYIFPTYGVTPNHSAFSMHALLVNHYMKGGFYPRGGSSEIAFHTIPVIQRA
GGAVLTKATVQSVLLDSAGKACGVSVKKGHELVNIYCPIVVSNAGLFNTYEHLLPGNARCLP
GVKQQLGTVRPGLGMTSVFICLRGTKEDLHLPSTNYYVYYDTDMDQAMERYVSMPREEAAEH
IPLLFFAFPSAKDPTWEDRFPGRSTMIMLIPTAYEWFEEWQAELKGKRGSDYETFKNSFVEA
SMSVVLKLFPQLEGKVESVTAGSPLTNQFYLAAPRGACYGADHDLGRLHPCVMASLRAQSPI
PNLYLTGQDIFTCGLVGALQGALLCSSAILKRNLYSDLKNLDSRIRAQKKKN

FIGURE 65

```
GCAGCGGCGAGGCGGCGGTGGTGGCTGAGTCCGTGGTGGCAGAGGCGAAGGCGACAGCTCTA
GGGGTTGGCACCGGCCCCGAGAGGAGGATGCGGGTCCGGATAGGGCTGACGCTGCTGCTGTG
TGCGGTGCTGCTGAGCTTGGCCTCGGCGTCCTCGGATGAAGAAGGCAGCCAGGATGAATCCT
TAGATTCCAAGACTACTTTGACATCAGATGAGTCAGTAAAGGACCATACTACTGCAGGCAGA
GTAGTTGCTGGTCAAATATTTCTTGATTCAGAAGAATCTGAATTAGAATCCTCTATTCAAGA
AGAGGAAGACAGCCTCAAGAGCCAAGAGGGGGAAAGTGTCACAGAAGATATCAGCTTTCTAG
AGTCTCCAAATCCAGAAAACAAGGACTATGAAGAGCCAAAGAAAGTACGGAAACCAGCTTTG
ACCGCCATTGAAGGCACAGCACATGGGGAGCCCTGCCACTTCCCTTTTCTTTTCCTAGATAA
GGAGTATGATGAATGTACATCAGATGGGAGGGAAGATGGCAGACTGTGGTGTGCTACAACCT
ATGACTACAAAGCAGATGAAAAGTGGGGCTTTTGTGAAACTGAAGAAGAGGCTGCTAAGAGA
CGGCAGATGCAGGAAGCAGAAATGATGTATCAAACTGGAATGAAAATCCTTAATGGAAGCAA
TAAGAAAAGCCAAAAAGAGAAGCATATCGGTATCTCCAAAAGGCAGCAAGCATGAACCATA
CCAAAGCCCTGGAGAGAGTGTCATATGCTCTTTTATTTGGTGATTACTTGCCACAGAATATC
CAGGCAGCGAGAGAGATGTTTGAGAAGCTGACTGAGGAAGGCTCTCCCAAGGGACAGACTGC
TCTTGGCTTTCTGTATGCCTCTGGACTTGGTGTTAATTCAAGTCAGGCAAAGGCTCTTGTAT
ATTATACATTTGGAGCTCTTGGGGCAATCTAATAGCCCACATGGTTTTGGTAAGTAGACTT
TAGTGGAAGGCTAATAATATTAACATCAGAAGAATTTGTGGTTTATAGCGGCCACAACTTTT
TCAGCTTTCATGATCCAGATTTGCTTGTATTAAGACCAAATATTCAGTTGAACTTCCTTCAA
ATTCTTGTTAATGGATATAACACATGGAATCTACATGTAAATGAAAGTTGGTGGAGTCCACA
ATTTTTCTTTAAAATGATTAGTTTGGCTGATTGCCCCTAAAAAGAGAGATCTGATAAATGGC
TCTTTTTAAATTTTCTCTGAGTTGGAATTGTCAGAATCATTTTTTACATTAGATTATCATAA
TTTTAAAAATTTTTCTTTAGTTTTTCAAAATTTTGTAAATGGTGGCTATAGAAAAACAACAT
GAAATATTATACAATATTTTGCAACAATGCCCTAAGAATTGTTAAAATTCATGGAGTTATTT
GTGCAGAATGACTCCAGAGAGCTCTACTTTCTGTTTTTTACTTTTCATGATTGGCTGTCTTC
CCATTTATTCTGGTCATTTATTGCTAGTGACACTGTGCCTGCTTCCAGTAGTCTCATTTTCC
CTATTTTGCTAATTTGTTACTTTTTCTTTGCTAATTTGGAAGATTAACTCATTTTTAATAAA
ATTATGTCTAAGATTAAAAAAAAAAAAAAAAAAAAAAAAAAAAAAAAAAAAAAAAAAAAAAAA
AAAAAAAAAAAAAAAAAAAAAAAAAAA
```

FIGURE 66

MRVRIGLTLLLCAVLLSLASASSDEEGSQDESLDSKTTLTSDESVKDHTTAGRVVAGQIFLD
SEESELESSIQEEEDSLKSQEGESVTEDISFLESPNPENKDYEEPKKVRKPALTAIEGTAHG
EPCHFPFLFLDKEYDECTSDGREDGRLWCATTYDYKADEKWGFCETEEEAAKRRQMQEAEMM
YQTGMKILNGSNKKSQKREAYRYLQKAASMNHTKALERVSYALLFGDYLPQNIQAAREMFEK
LTEEGSPKGQTALGFLYASGLGVNSSQAKALVYYTFGALGGNLIAHMVLSRL

FIGURE 67

CTTCCCAGCCCTGTGCCCCAAAGCACCTGGAGCATATAGCCTTGCAGAACTTCTACTTGCCT
GCCTCCCTGCCTCTGGCCATGGCCTGCCGGTGCCTCAGCTTCCTTCTGATGGGGACCTTCCT
GTCAGTTTCCCAGACAGTCCTGGCCCAGCTGGATGCACTGCTGGTCTTCCCAGGCCAAGTGG
CTCAACTCTCCTGCACGCTCAGCCCCCAGCACGTCACCATCAGGGACTACGGTGTGTCCTGG
TACCAGCAGCGGGCAGGCAGTGCCCCTCGATATCTCCTCTACTACCGCTCGGAGGAGGATCA
CCACCGGCCTGCTGACATCCCCGATCGATTCTCGGCAGCCAAGGATGAGGCCCACAATGCCT
GTGTCCTCACCATTAGTCCCGTGCAGCCTGAAGACGACGCGGATTACTACTGCTCTGTTGGC
TACGGCTTTAGTCCCTAGGGGTGGGGTGTGAGATGGGTGCCTCCCCTCTGCCTCCCATTTCT
GCCCCTGACCTTGGGTCCCTTTTAAACTTTCTCTGAGCCTTGCTTCCCCTCTGTAAAATGGG
TTAATAATATTCAACATGTCAACAAC

FIGURE 68

MACRCLSFLLMGTFLSVSQTVLAQLDALLVFPGQVAQLSCTLSPQHVTIRDYGVSWYQQRAG
SAPRYLLYYRSEEDHHRPADIPDRFSAAKDEAHNACVLTISPVQPEDDADYYCSVGYGFSP

FIGURE 69

```
GCCGCCCCGCCCCGAGACCGGGCCCGGGGGCGCGGGGCGGCGGGATGCGGCGCCCGGGGCGG
CGATGACCGCGGAGCGCACGCCGCGGGCCCGGCCCTGACCCCGCCGCCCGCCGCTGAGCCC
CCCGCCGAGGTCCGGACAGGCCGAGATGACGCCGAGCCCCTGTTGCTGCTCCTGCTGCCGC
CGCTGCTGCTGGGGGCCTTCCCACCGGCCGCCGCCGCCCGAGGCCCCCAAAGATGGCGGAC
AAGGTGGTCCCACGGCAGGTGGCCCGGCTGGGCCGCACTGTGCGGCTGCAGTGCCCAGTGGA
GGGGGACCCGCCCGCGCTGACCATGTGGACCAAGGATGGCCGCACCATCCACAGCGGCTGGA
GCCGCTTCCGCGTGCTGCCGCAGGGGCTGAAGGTGAAGCAGGTGGAGCGGGAGGATGCCGGC
GTGTACGTGTGCAAGGCCACCAACGGCTTCGGCAGCCTGAGCGTCAACTACACCCTCGTCGT
GCTGGATGACATTAGCCCAGGGAAGGAGAGCCTGGGGCCCGACAGCTCCTCTGGGGGTCAAG
AGGACCCCGCCAGCCAGCAGTGGGCACGACCGCGCTTCACACAGCCCTCCAAGATGAGGCGC
CGGGTGATCGCACGGCCCGTGGGTAGCTCCGTGCGGCTCAAGTGCGTGGCCAGCGGGCACCC
TCGGCCCGACATCACGTGGATGAAGGACGACCAGGCCTTGACGCGCCCAGAGGCCGCTGAGC
CCAGGAAGAAGAAGTGGACACTGAGCCTGAAGAACCTGCGGCCGGAGGACAGCGGCAAATAC
ACCTGCCGCGTGTCGAACCGCGCGGGCGCCATCAACGCCACCTACAAGGTGGATGTGATCCA
GCGGACCCGTTCCAAGCCCGTGCTCACAGGCACGCACCCCGTGAACACGACGGTGGACTTCG
GGGGGACCACGTCCTTCCAGTGCAAGGTGCGCAGCGACGTGAAGCCGGTGATCCAGTGGCTG
AAGCGCGTGGAGTACGGCGCCGAGGGCCGCCACAACTCCACCATCGATGTGGGCGGCCAGAA
GTTTGTGGTGCTGCCCACGGGTGACGTGTGGTCGCGGCCCGACGGCTCCTACCTCAATAAGC
TGCTCATCACCCGTGCCCGCCAGGACGATGCGGGCATGTACATCTGCCTTGGCGCCAACACC
ATGGGCTACAGCTTCCGCAGCGCCTTCCTCACCGTGCTGCCAGACCCAAAACCGCCAGGGCC
ACCTGTGGCCTCCTCGTCCTCGGCCACTAGCCTGCCGTGGCCCGTGGTCATCGGCATCCCAG
CCGGCGCTGTCTTCATCCTGGGCACCCTGCTCCTGTGGCTTTGCCAGGCCCAGAAGAAGCCG
TGCACCCCGCGCCTGCCCCTCCCCTGCCTGGGCACCGCCCGCCGGGGACGGCCCGCGACCG
CAGCGGAGACAAGGACCTTCCCTCGTTGGCCGCCCTCAGCGCTGGCCCTGGTGTGGGGCTGT
GTGAGGAGCATGGGTCTCCGGCAGCCCCCAGCACTTACTGGGCCCAGGCCCAGTTGCTGGC
CCTAAGTTGTACCCCAAACTCTACACAGACATCCACACACACACACACACACACACTCTCACAC
ACACTCACACGTGGAGGGCAAGGTCCACCAGCACATCCACTATCAGTGCTAGACGGCACCGT
ATCTGCAGTGGGCACGGGGGGGCCGGCCAGACAGGCAGACTGGGAGGATGGAGGACGGAGCT
GCAGACGAAGGCAGGGGACCCATGGCGAGGAGGAATGGCCAGCACCCCAGGCAGTCTGTGTG
TGAGGCATAGCCCCTGGACACACACACACAGACACACACACTACCTGGATGCATGTATGCAC
ACACATGCGCGCACACGTGCTCCCTGAAGGCACACGTACGCACACGCACATGCACAGATATG
CCGCCTGGGCACACAGATAAGCTGCCCAAATGCACGCACACGCACAGAGACATGCCAGAACA
TACAAGGACATGCTGCCTGAACATACACGCACACCCATGCGCAGATGTGCTGCCTGGACA
CACACACACACACACGGATATGCTGTCTGGACGCACACACGTGCAGATATGGTATCCGGACACA
CACGTGCACAGATATGCTGCCTGGACACACAGATAATGCTGCCTTGACACACACATGCACGG
ATATTGCCTGGACACACACACACACACACGCGTGCACAGATATGCTGTCTGGACACGCACAC
ACATGCAGATATGCTGCCTGGACACACACTTCCAGACACACGTGCACAGGCGCAGATATGCT
GCCTGGACACACGCAGATATGCTGTCTAGTCACACACACACGCAGACATGCTGTCCGGACAC
ACACACGCATGCACAGATATGCTGTCCGGACACACACACGCACGCAGATATGCTGCCTGGAC
ACACACACAGATAATGCTGCCTCAACACTCACACACGTGCAGATATTGCCTGGACACACACA
TGTGCACAGATATGCTGTCTGGACATGCACACACGTGCAGATATGCTGTCCGGATACACACG
CACGCACACATGCAGATATGCTGCCTGGGCACACACTTCCGGACACACATGCACACACAGGT
GCAGATATGCTGCCTGGACACACACACACAGATAATGCTGCCTCAACACTCACACACGTGCAGA
TATTGCCTGGACACACACATGTGCACAGATATGCTGTCTGGACATGCACACACGTGCAGATA
TGCTGTCCGGATACACACGCACGCACACATGCAGATATGCTGCCTGGGCACACACTTCCGGA
CACACATGCACACACAGGTGCAGATATGCTGCCTGGACACACGCAGACTGACGTGCTTTTGG
GAGGGTGTGCCGTGAAGCCTGCAGTACGTGTGCCGTGAGGCTCATAGTTGATGAGGGACTTT
CCCTGCTCCACCGTCACTCCCCCAACTCTGCCCGCCTCTGTCCCCGCCTCAGTCCCCGCCTC
CATCCCCGCCTCTGTCCCCTGGCCTTGGCGGCTATTTTTGCCACCTGCCTTGGGTGCCCAGG
AGTCCCCTACTGCTGTGGGCTGGGGTTGGGGCACAGCAGCCCCAAGCCTGAGAGGCTGGAG
CCCATGGCTAGTGGCTCATCCCCAGTGCATTCTCCCCTGACACAGAAGGGGCCTTGGTA
TTTATATTTAAGAAATGAAGATAATATTAATAATGATGGAAGGAAGACTGGGTTGCAGGGAC
TGTGGTCTCTCCTGGGGCCCGGGACCCGCCTGGTCTTTCAGCCATGCTGATGACCACACCCC
GTCCAGGCCAGACACCACCCCCACCCCACTGTCGTGGTGGCCCCAGATCTCTGTAATTTTA
TGTAGAGTTTGAGCTGAAGCCCCGTATATTTAATTTATTTTGTTAAACACAAAA
```

FIGURE 70

MTPSPLLLLLLPPLLLGAFPPAAAARGPPKMADKVVPRQVARLGRTVRLQCPVEGDPPPLTM
WTKDGRTIHSGWSRFRVLPQGLKVKQVEREDAGVYVCKATNGFGSLSVNYTLVVLDDISPGK
ESLGPDSSSGGQEDPASQQWARPRFTQPSKMRRRVIARPVGSSVRLKCVASGHPRPDITWMK
DDQALTRPEAAEPRKKKWTLSLKNLRPEDSGKYTCRVSNRAGAINATYKVDVIQRTRSKPVL
TGTHPVNTTVDFGGTTSFQCKVRSDVKPVIQWLKRVEYGAEGRHNSTIDVGGQKFVVLPTGD
VWSRPDGSYLNKLLITRARQDDAGMYICLGANTMGYSFRSAFLTVLPDPKPPGPPVASSSSA
TSLPWPVVIGIPAGAVFILGTLLLWLCQAQKKPCTPAPAPPLPGHRPPGTARDRSGDKDLPS
LAALSAGPGVGLCEEHGSPAAPQHLLGPGPVAGPKLYPKLYTDIHTHTHTHSHTHSHVEGKV
HQHIHYQC

FIGURE 71

```
CCCAGCTGAGGAGCCCTGCTCAAGACACGGTCACTGGATCTGAGAAACTTCCCAGGGGACCGCATTCCAGAGTC
AGTGACTCTGTGAAGCACCCACATCTACCTCTTGCCACGTTCCCACGGGCTTGGGGGAAAGATGGTGGGGACCA
AGGCCTGGGTGTTCTCCTTCCTGGTCCTGGAAGTCACATCTGTGTTGGGGAGACAGACGATGCTCACCCAGTCA
GTAAGAAGAGTCCAGCCTGGGAAGAAGAACCCCAGCATCTTTGCCAAGCCTGCCGACACCCTGGAGAGCCCTGG
TGAGTGGACAACATGGTTCAACATCGACTACCCAGGCGGGAAGGGCGACTATGAGCGGCTGGACGCCATTCGCT
TCTACTATGGGGACCGTGTATGTGCCCGTCCCCTGCGGCTAGAGGCTCGGACCACTGACTGGACACCTGCGGGC
AGCACTGGCCAGGTGGTCCATGGTAGTCCCCGTGAGGGTTTCTGGTGCCTCAACAGGGAGCAGCGGCCTGGCCA
GAACTGCTCTAATTACACCGTACGCTTCCTCTGCCCACCAGGATCCCTGCGCCGAGACACAGAGCGCATCTGGA
GCCCATGGTCTCCCTGGAGCAAGTGCTCAGCTGCCTGTGGTCAGACTGGGGTCCAGACTCGCACACGCATTTGC
TTGGCAGAGATGGTGTCGCTGTGCAGTGAGGCCAGCGAAGAGGGTCAGCACTGCATGGGCCAGGACTGTACAGC
CTGTGACCTGACCTGCCCAATGGGCCAGGTGAATGCTGACTGTGATGCCTGCATGTGCCAGGACTTCATGCTTC
ATGGGGCTGTCTCCCTTCCCGGAGGTGCCCCAGCCTCAGGGGCTGCTATCTACCTCCTGACCAAGACGCCGAAG
CTGCTGACCCAGACAGACAGTGATGGGAGATTCCGAATCCCTGGCTTGTGCCCTGATGGCAAAAGCATCCTGAA
GATCACAAAGGTCAAGTTTGCCCCCATTGTACTCACAATGCCCAAGACTAGCCTGAAGGCAGCCACCATCAAGG
CAGAGTTTGTGAGGGCAGAGACTCCATACATGGTGATGAACCCTGAGACAAAAGCACGGAGAGCTGGGCAGAGC
GTGTCTCTGTGCTGTAAGGCCACAGGGAAGCCCAGGCCAGACAAGTATTTTTGGTATCATAATGACACATTGCT
GGATCCTTCCCTCTACAAGCATGAGAGCAAGCTGGTGCTGAGGAAACTGCAGCAGCACCAGGCTGGGGAGTACT
TTTGCAAGGCCCAGAGTGATGCTGGGGCTGTGAAGTCCAAGGTTGCCCAGCTGATTGTCACAGCATCTGATGAG
ACTCCTTGCAACCCAGTTCCTGAGAGCTATCTTATCCGGCTGCCCCATGATTGCTTTCAGAATGCCACCAACTC
CTTCTACTATGACGTGGGACGCTGCCCTGTTAAGACTTGTGCAGGGCAGCAGGATAATGGGATCAGGTGCCGTG
ATGCTGTGCAGAACTGCTGTGGCATCTCCAAGACAGAGGAAAGGGAGATCCAGTGCAGTGGCTACACGCTACCC
ACCAAGGTGGCCAAGGAGTGCAGCTGCCAGCGGTGCCAGGAAACTCGGAGCATCGTGCGGGGCCGTGTCAGTGC
TGCTGACAATGGGGAGCCCATGCGCTTTGGCCATGTGTACATGGGGAACAGCCGTGTAAGCATGACTGGCTACA
AGGGCACTTTCACCCTCCATGTCCCCCAGGACACTGAGAGGCTGGTGCTCACATTTGTGGACAGGCTGCAGAAG
TTTGTCAACACCACCAAAGTGCTACCTTTCAACAAGAAGGGGAGTGCCGTGTTCCATGAAATCAAGATGCTTCG
TCGGAAAGAGCCCATCACTTTGGAAGCCATGGAGACCAACATCATCCCCCTGGGGGAAGTGGTTGGTGAAGACC
CCATGGCTGAACTGGAGATTCCATCCAGGAGTTTCTACAGGCAGAATGGGGAGCCCTACATAGGAAAAGTGAAG
GCCAGTGTGACCTTCCTGGATCCCCGGAATATTTCCACAGCCACAGCCTGCCCAGACTGACCTGAACTTCATCAA
TGACGAAGGAGACACTTTCCCCCCTTCGGACGTATGGCATGTTCTCTGTGGACTTCAGAGATGAGGTCACCTCAG
AGCCACTTAATGCTGGCAAAGTGAAGGTCCACCTTGACTCGACCCAGGTCAAGATGCCAGAGCACATATCCACA
GTGAAACTCTGGTCACTCAATCCAGACACAGGGCTGTGGGAGGAGGAAGGTGATTTCAAATTTGAAAATCAAAG
GAGGAACAAAAGAGAGACAGAACCTTCCTGGTGGGCAACCTGGAGATTCGTGAGGAGGAGGCTCTTTAACCTGG
ATGTTCCTGAAAGCAGGCGGTGCTTTGTTAAGGTGAGGGCCTACCGGAGTGAGAGGTTCTTGCCTAGTGAGCAG
ATCCAGGGGGTTGTGATCTCCGTGATTAACCTGGAGCCTAGAACTGGCTTCTTGTCCAACCCTAGGGCCTGGGG
CCGCTTTGACAGTGTGTCATCACAGGCCCCAACGGGGCCTGTGTGCCTGCCTTCTGTGATGACCAGTCCCCTGATG
CCTACTCTGCCTATGTCTTGGCAAGCCTGGCTGGGGAGGAACTGCAAGCAGTGGAGTCTTCTCCTAAATTCAAC
CCAAATGCAATTGGCGTCCCTCAGCCCTATCTCAACAAGCTCAACTACCGTCGGACGGACCATGAGGATCCACG
GGTTAAAAAGACAGCTTTCCAGATTAGCATGGCCAAGCCAAGCCCAACCTCAGCTGAGGAGGAGCAATGGGCCCA
TCTATGCCTTTGAGAACCTCCGGGCATGTGAAGAGGCACCACCCAGTGCAGCCCACTTCCGGTTCTACCAGATT
GAGGGGGATCGATATGACTACAACACAGTCCCCTTCAACGAAGATGACCCTATGAGCTGGACTGAAGACTATCT
GGCATGGTGCCAAAGCCGATGGAATTCAGGGCCTGCTATATCAAGGTGAAGATTGTGGGGCCACTGGAAGTGA
ATGTGCGATCCCGCCAACATGGGGGGCACTCATCGGCGGACAGTGGGGAAGCTGTATGGAATCCGAGATGTGAGG
AGCACTCGGGACAGGGACCAGCCCAATGTCTCAGCTGCCTGTCTGGAGTTCAAGTGCAGTGGGATGCTCTATGA
TCAGGACCGTGTGGACCGCACCCTGGTGAAGGTCATCCCCCAGGGCAGCTGCCGTCGAGCCCAGTGTGAACCCA
TGCTGCATGAGTACCTGGTCAACCACTTGCCACTTGCAGTCAACAACGACACCAGTGAGTACACCATGCTGGCA
CCCTTGGACCCACTGGGCCACAACTATGGCATCTACACTGTCACTGACCAGGACCCTCGCACGGCCAAGGAGAT
CGCGCTCGGCCGGTGCTTTGATGGCACATCCGATGGCTCCTCCAGAATCATGAAGAGCAATGTGGGAGTAGCCC
TCACCTTCAACTGTGTAGAGAGGCAAGTAGGCCGCCAGGATGCCTTCCAGTACCTCCAAAGCACCCCAGCCCAG
TCCCCTGCTGCAGGCACTGTCCAAGGAAGAGTGCCCTCGAGGAGGCAGCAGCGAGCGAGCAGGGGTGGCCAGCG
CCAGGGTGGAGTGGTGGCCTCTCTGAGATTTCCTAGAGTTGCTCAACAGCCCCTGATCAACTAAGTTTTGTGGT
ACTTCACCCTCTTCTGCCCTCATTTCATGTGACAGCCATTGTGAGACTGATGCACAAACTGTCACTTGGTTAAT
TTAAGCACTTCTGTTTTCGTGAATTTGCTTGTTTGTTTCTTCATGCCTTTACTTACTTTGTCCCATGCTACTGA
TTGGCACGTGGCCCCCACAATGGCACAATAAAGCCCCTTTGTGAAACTGTTCTTTAAATGAAACACAAGAAATT
GGCCACTGGTAAAACTCTGCAGCTTCAACTGTACTTCATTTAATGCCATTAATGCAAATATACTTCCTCTTCTT
TTTGCATGGTTTTGCCCACCTCTGCAATAGTGATAATCTGATGCTGAAGATCAAATAACCAATATAAAGCATAT
TTCTTGGCCTTGCTCCACAGGACATAGGCAAGCCTTGATCATAGTTCATACATATAAATGGTGGTGAAATAAAG
AAATAAAACACAATACTTTTACTTGAAATGTAAATAACTTATTTATTTCTTTGCTAAATTTGGAATTCTAGTGC
ACATTCAAAGTTAAGCTATTAAATATAGGGTGATCATAGTTCCTCTACCAAGTCTGGAAAGAACATCTCCTGGT
ATCCACAATTACACCAGGTTGCTAACTGTATTTGTACATTTCCCTTTGCATTCGCTTTTGTTCTTGCTAGAAAC
CCAGTGTAGCCCAGGGCAGATGTCAATAAATGCATACTCTGTATTTCGAAAAAA
```

FIGURE 72

MVGTKAWVFSFLVLEVTSVLGRQTMLTQSVRRVQPGKKNPSIFAKPADTLESPGEWTTWFNI
DYPGGKGDYERLDAIRFYYGDRVCARPLRLEARTTDWTPAGSTGQVVHGSPREGFWCLNREQ
RPGQNCSNYTVRFLCPPGSLRRDTERIWSPWSPWSKCSAACGQTGVQTRTRICLAEMVSLCS
EASEEGQHCMGQDCTACDLTCPMGQVNADCDACMCQDFMLHGAVSLPGGAPASGAAIYLLTK
TPKLLTQTDSDGRFRIPGLCPDGKSILKITKVKFAPIVLTMPKTSLKAATIKAEFVRAETPY
MVMNPETKARRAGQSVSLCCKATGKPRPDKYFWYHNDTLLDPSLYKHESKLVLRKLQQHQAG
EYFCKAQSDAGAVKSKVAQLIVTASDETPCNPVPESYLIRLPHDCFQNATNSFYYDVGRCPV
KTCAGQQDNGIRCRDAVQNCCGISKTEEREIQCSGYTLPTKVAKECSCQRCTETRSIVRGRV
SAADNGEPMRFGHVYMGNSRVSMTGYKGTFTLHVPQDTERLVLTFVDRLQKFVNTTKVLPFN
KKGSAVFHEIKMLRRKEPITLEAMETNIIPLGEVVGEDPMAELEIPSRSFYRQNGEPYIGKV
KASVTFLDPRNISTATAAQTDLNFINDEGDTFPLRTYGMFSVDFRDEVTSEPLNAGKVKVHL
DSTQVKMPEHISTVKLWSLNPDTGLWEEEGDFKFENQRRNKREDRTFLVGNLEIRERRLFNL
DVPESRRCFVKVRAYRSERFLPSEQIQGVVISVINLEPRTGFLSNPRAWGRFDSVITGPNGA
CVPAFCDDQSPDAYSAYVLASLAGEELQAVESSPKFNPNAIGVPQPYLNKLNYRRTDHEDPR
VKKTAFQISMAKPRPNSAEESNGPIYAFENLRACEEAPPSAAHFRFYQIEGDRYDYNTVPFN
EDDPMSWTEDYLAWWPKPMEFRACYIKVKIVGPLEVNVRSRNMGGTHRRTVGKLYGIRDVRS
TRDRDQPNVSAACLEFKCSGMLYDQDRVDRTLVKVIPQGSCRRASVNPMLHEYLVNHLPLAV
NNDTSEYTMLAPLDPLGHNYGIYTVTDQDPRTAKEIALGRCFDGTSDGSSRIMKSNVGVALT
FNCVERQVGRQSAFQYLQSTPAQSPAAGTVQGRVPSRRQQRASRGGQRQGGVVASLRFPRVA
QQPLIN

FIGURE 73

```
CTGCAAGTTGTTAACGCCTAACACACAAGTATGTTAGGCTTCCACCAAAGTCCTCAATATACCTGAATACGCAC
AATATCTTAACTCTTCATATTTGGTTTTGGGATCTGCTTTGAGGTCCCATCTTCATTTAAAAAAAAATACAGAG
ACCTACCTACCCGTACGCATACATACATATGTGTATATATATGTAAACTAGACAAAGATCGCAGATCATAAAGC
AAGCTCTGCTTTAGTTTCCAAGAAGATTACAAAGAATTTAGAGATGTATTTGTCAAGATCCCTGTCGATTCATG
CCCTTTGGGTTACGGTGTCCTCAGTGATGCAGCCCTACCCTTTGGTTTGGGGACATTATGATTTGTGTAAGACT
CAGATTTACACGGAAGAAGGGAAAGTTTGGGATTACATGGCCTGCCAGCCGGAATCCACGGACATGACAAAATA
TCTGAAAGTGAAACTCGATCCTCCGGATATTACCTGTGGAGACCCTCCTGAGACGTTCTGTGCAATGGGCAATC
CCTACATGTGCAATAATGAGTGTGATGCGAGTACCCCTGAGCTGGCACACCCCCCTGAGCTGATGTTTGATTTT
GAAGGAAGACATCCCTCCACATTTTGGCAGTCTGCCACTTGGAAGGAGTATCCCAAGCCTCTCCAGGTTAACAT
CACTCTGTCTTGGAGCAAAACCATTGAGCTAACAGACAACATAGTTATTACCTTTGAATCTGGGCGTCCAGACC
AAATGATCCTGGAGAAGTCTCTCGATTATGGACGAACATGGCAGCCCTATCAGTATTATGCCACAGACTGCTTA
GATGCTTTTCACATGGATCCTAAATCCGTGAAGGATTTATCACAGCATACGGTCTTAGAAATCATTTGCACAGA
AGAGTACTCAACAGGGTATACAACAAATAGCAAAATAATCCACTTTGAAATCAAAGACAGGTTCGCGCTTTTTG
CTGGACCTCGCCTACGCAATATGGCTTCCTCTACGGACAGCTGGATACAACCAAGAAACTCAGAGATTTCTTT
ACAGTCACAGACCTGAGGATAAGGCTGTTAAGACCAGCCGTTGGGGAAATATTTGTAGATGAGCTACACTTGGC
ACGCTACTTTTACGCGATCTCAGACATAAAGGTGCGAGGAAGGTGCAAGTGTAATCTCCATGCCACTGTATGTG
TGTATGACAACAGCAAATTGACATGCGAATGTGAGCACAACACTACAGGTCCAGACTGTGGGAAATGCAAGAAG
AATTATCAGGGCCGACCTTGGAGTCCAGGCTCCTATCTCCCCATCCCCAAAGGCACTGCAAATACCTGTATCCC
CAGTATTTCCAGTATTGGTACGAATGTCTGCGACAACGAGCTCCTGCACTGCCAGAACGGAGGGACGTGCCACA
ACAACGTGCGCTGCCTGTGCCCGGCCGCATACACGGGCATCCTCTGCGAGAAGCTGCGGTGCGAGGAGGCTGGC
AGCTGCGGCTCCGACTCTGGCCAGGGCGCGCCCCGCACGGCACCCAGCGCTGCTGCTGCTGACCACGCTGCT
GGGAACCGCCAGCCCCCTGGTGTTCTAGGTGTCACCTCCAGCCACACCGGACGGGCCTGTGCCGTGGGGAAGCA
GACACAACCCAAACATTTGCTACTAACATAGGAAACACACACATACAGACACCCCCACTCAGACAGTGTACAAA
CTAAGAAGGCCTAACTGAACTAAGCCATATTTATCACCCGTGGACAGCACATCCGAGTCAAGACTGTTAATTTC
TGACTCCAGAGGAGTTGGCAGCTGTTGATATTATCACTGCAAATCACATTGCCAGCTGCAGAGCATATTGTGGA
TTGGAAAGGCTGCGACAGCCCCCCAAACAGGAAAGACAAAAAACAAACAAATCAACCGACCTAAAAACATTGGC
TACTCTAGCGTGGTGCGCCCTAGTACGACTCCGCCCAGTGTGTGGACCAACCAAATAGCATTCTTTGCTGTCAG
GTGCATTGTGGGCATAAGGAAATCTGTTACAAGCTGCCATATTGGCCTGCTTCCGTCCCTGAATCCCTTCCAAC
CTGTGCTTTAGTGAACGTTGCTCTGTAACCCTCGTTGGTTGAAAGATTTCTTTGTCTGATGTTAGTGATGCACA
TGTGTAACAGCCCCCTCTAAAAGCGCAAGCCAGTCATACCCCTGTATATCTTAGCAGCACTGAGTCCAGTGCGA
GCACACACCCACTATACAAGAGTGGCTATAGGAAAAAGAAAGTGTATCTATCCTTTTGTATTCAAATGAAGTT
ATTTTTCTTGAACTACTGTAATATGTAGATTTTTTGTATTATTGCCAATTTGTGTTACCAGACAATCTGTTAAT
GTATCTAATTCGAATCAGCAAAGACTGACATTTTATTTTGTCCTCTTTCGTTCTGTTTTGTTTCACTGTGCAGA
GATTTCTCTGTAAGGGCAACGAACGTGCTGGCATCAAAGAATATCAGTTTACATATATAACAAGTGTAATAAGA
TTCCACCAAAGGACATTCTAAATGTTTTCTTGTTGCTTTAACACTGGAAGATTTAAAGAATAAAAACTCCTGCA
TAAACGATTTCAGGAATTTGTATTGCAATTTCTTAAGATGAAAGGAACAGCCACCAAGCAGTTTCACACTCACT
TTACTGATTTCTGTGTGGACTGAGTACATTCAGCTGACGAATTTAGTTCCCAGGAAGATGGATTGATGTTCACT
AGCTTGGACAACTTCTGCAAAATATGAGACTATTTCCACTTGGGAAAAATTACAACAGCAAAAAAAAAAAAAA
AAAAAA
```

FIGURE 74

MYLSRSLSIHALWVTVSSVMQPYPLVWGHYDLCKTQIYTEEGKVWDYMACQPESTDMTKYLK
VKLDPPDITCGDPPETFCAMGNPYMCNNECDASTPELAHPPELMFDFEGRHPSTFWQSATWK
EYPKPLQVNITLSWSKTIELTDNIVITFESGRPDQMILEKSLDYGRTWQPYQYYATDCLDAF
HMDPKSVKDLSQHTVLEIICTEEYSTGYTTNSKIIHFEIKDRFALFAGPRLRNMASLYGQLD
TTKKLRDFFTVTDLRIRLLRPAVGEIFVDELHLARYFYAISDIKVRGRCKCNLHATVCVYDN
SKLTCECEHNTTGPDCGKCKKNYQGRPWSPGSYLPIPKGTANTCIPSISSIGTNVCDNELLH
CQNGGTCHNNVRCLCPAAYTGILCEKLRCEEAGSCGSDSGQGAPPHGTPALLLLTTLLGTAS
PLVF

FIGURE 75

CCCACGCGTCCGGGTGACCTGGGCCGAGCCCTCCCGGTCGGCTAAGATTGCTGAGGAGGCGG
CGGGTAGCTGGCAGGCGCCGACTTCCGAAGGCCGCCGTCCGGGCGAGGTGTCCTCATGACTT
CTCTTGTGGACCATGTCCGTGATCTTTTTTGCCTGCGTGGTACGGGTAAGGGATGGACTGCC
CCTCTCAGCCTCTACTGATTTTTACCACACCCAAGATTTTTTGGAATGGAGGAGACGGCTCA
AGAGTTTAGCCTTGCGACTGGCCCAGTATCCAGGTCGAGGTTCTGCAGAAGGTTGTGACTTT
AGTATACATTTTTCTTCTTTCGGGGACGTGGCCTGCATGGCTATCTGCTCCTGCCAGTGTCC
AGCAGCCATGGCCTTCTGCTTCCTGGAGACCCTGTGGTGGGAATTCACAGCTTCCTATGACA
CTACCTGCATTGGCCTAGCCTCCAGGCCATACGCTTTTCTTGAGTTTGACAGCATCATTCAG
AAAGTGAAGTGGCATTTTAACTATGTAAGTTCCTCTCAGATGGAGTGCAGCTTGGAAAAAAT
TCAGGAGGAGCTCAAGTTGCAGCCTCCAGCGGTTCTCACTCTGGAGGACACAGATGTGGCAA
ATGGGGTGATGAATGGTCACACACCGATGCACTTGGAGCCTGCTCCTAATTTCCGAATGGAA
CCAGTGACAGCCCTGGGTATCCTCTCCCTCATTCTCAACATCATGTGTGCTGCCCTGAATCT
CATTCGAGGAGTTCACCTTGCAGAACATTCTTTACAGGATCCAAGGAGCTGGTTCTGCTGGT
TGGACCAAACCTCGTGAGCCAGCCACCCCTGACCCAAATGAGGAGAGCTCTGATTCTCCCAT
CCGGGAGCAGTGATGTCAAACTTCTGCTGCTGGGGAAATCTCATCAGCAGGGAGCCTGTGGA
AAAGGGCATGTCAGTGAAATCTGGGAATGGCTGGATTCGGAAACATCTGCCCATGTGTATTG
ATGGCAGAGCTGTTGCCCACAAGCGCCTTTTATTTAGGGTAAAATTAACAAATCCATTCTAT
TCCTCTGACCCATGCTTAGTACATATGACCTTTAACCCTTACATTTATATGATTCTGGGGTT
GCTTCAGAAGTGTTATTTCATGAATCATTCATATGATTTGATCCCCCAGGATTCTATTTTGT
TTAATGGGCTTTTCTACTAAAAGCATAAAATACTGAGGCTGATTTAGTCAGGGCAAAACCAT
TTACTTTACATATTCGTTTTCAATACTTGCTGTTCATGTTACACAAGCTTCTTACGGTTTTC
TTGTAACAATAAATATTTTGAGTAAATAATGGGTACATTTTAACAAACTCAGTAGTACAACC
TAAACTTGTATAAAAGTGTGTAAAAATGTATAGCCATTTATATCCTATGTATAAATTAAATG
AGGTGGCTTCAGAAATGGCAGAATAAATCTAAAGTGTTTATTAAAAAAAAAAAAAAAAAAAA
AAAAG

FIGURE 76

MSVIFFACVVRVRDGLPLSASTDFYHTQDFLEWRRRLKSLALRLAQYPGRGSAEGCDFSIHF
SSFGDVACMAICSCQCPAAMAFCFLETLWWEFTASYDTTCIGLASRPYAFLEFDSIIQKVKW
HFNYVSSSQMECSLEKIQEELKLQPPAVLTLEDTDVANGVMNGHTPMHLEPAPNFRMEPVTA
LGILSLILNIMCAALNLIRGVHLAEHSLQDPRSWFCWLDQTS

FIGURE 77

TGCTTCCTGGAGACCCTGTGGTGGGAATTCACAGCTTCNTATGACACTACCTGCATTGGCNT
AGCCTCCAGGCCATACGCTTTTCTTGAGTTTGACAGCATCATTCAGAAAGTGAAGTGGCATT
TTAACTATGTAAGTTCCTNTCAGATGGAGTGCAGCTTGGAAAAAATTCAGGAGGAGCTCAAG
TTGCAGCCTCCAGCGGTTCTCANTATGGAGGACACAGATGTGGCAAATGGGGT

FIGURE 78

```
CTCAGCGGCGCTTCCTCGTAGCGAGCCTAGTGGCGGGTGTTTGCATTGAAACGTGAGCGCGA
CCCGACCTTAAAGAGTGGGGAGCAAAGGGAGGACAGAGCCCTTTAAAACGAGGCGGGTGGTG
CCTGCCCCTTTAAGGGCGGGGCGTCCGGACGACTGTATCTGAGCCCCAGACTGCCCCGAGTT
TCTGTCGCAGGCTGCGAGGAAAGGCCCCTAGGCTGGGTCTGGGTGCTTGGCGGCGGCGGCTT
CCTCCCCGCTCGTCCTCCCCGGGCCCAGAGGCACCTCGGCTTCAGTCATGCTGAGCAGAGTA
TGGAAGCACCTGACTACGAAGTGCTATCCGTGCGAGAACAGCTATTCCACGAGAGGATCCGC
GAGTGTATTATATCAACACTTCTGTTTGCAACACTGTACATCCTCTGCCACATCTTCCTGAC
CCGCTTCAAGAAGCCTGCTGAGTTCACCACAGTGGATGATGAAGATGCCACCGTCAACAAGA
TTGCGCTCGAGCTGTGCACCTTTACCCTGGCAATTGCCCTGGGTGCTGTCCTGCTCCTGCCC
TTCTCCATCATCAGCAATGAGGTGCTGCTCTCCCTGCCTCGGAACTACTACATCCAGTGGCT
CAACGGCTCCCTCATCCATGGCCTCTGGAACCTTGTTTTTCTCTTCCCCAACCTGTCCCTCA
TCTTCCTCATGCCCTTTGCATATTTCTTCACTGAGTCTCAGGGCTTTGCTGGCTCCAGAAAG
GGTGTCCTGGGCCGGGTCTATGAGACAGTGGTGATGTTGATGCTCCTCACTCTGCTGGTGCT
AGGTATGGTGTGGGTGGCATCAGCCATTGTGGACAAGAACAAGGCCAACAGAGAGTCACTCT
ATGACTTTTGGGAGTACTATCTCCCCTACCTCTACTCATGCATCTCCTTCCTTGGGGTTCTG
CTGCTCCTGGTGTGTACTCCACTGGGTCTCGCCCGCATGTTCTCCGTCACTGGGAAGCTGCT
AGTCAAGCCCCGGCTGCTGGAAGACCTGGAGGAGCAGCTGTACTGCTCAGCCTTTGAGGAGG
CAGCCCTGACCCGCAGGATCTGTAATCCTACTTCCTGCTGGCTGCCTTTAGACATGGAGCTG
CTACACAGACAGGTCCTGGCTCTGCAGACACAGAGGGTCCTGCTGGAGAAGAGGCGGAAGGC
TTCAGCCTGGCAACGGAACCTGGGCTACCCCTGGCTATGCTGTGCTTGCTGGTGCTGACGG
GCCTGTCTGTGCTCATTGTGGCCATCCACATCCTGGAGCTGCTCATCGATGAGGCTGCCATG
CCCCGAGGCATGCAGGGTACCTCCTTAGGCCAGGTCTCCTTCTCCAAGCTGGGCTCCTTTGG
TGCCGTCATTCAGGTTGTACTCATCTTTTACCTAATGGTGTCCTCAGTTGTGGGCTTCTATA
GCTCTCCACTCTTCCGGAGCCTGCGGCCCAGATGGCACGACACTGCCATGACGCAGATAATT
GGGAACTGTGTCTGTCTCCTGGTCCTAAGCTCAGCACTTCCTGTCTTCTCTCGAACCCTGGG
GCTCACTCGCTTTGACCTGCTGGGTGACTTTGGACGCTTCAACTGGCTGGGCAATTTCTACA
TTGTGTTCCTCTACAACGCAGCCTTTGCAGGCCTCACCACACTCTGTCTGGTGAAGACCTTC
ACTGCAGCTGTGCGGGCAGAGCTGATCCGGGCCTTTGGCTGGACAGACTGCCGCTGCCCGT
CTCCGGTTTCCCCCAGGCATCTAGGAAGACCCAGCACCAGTGACCTCCAGCTGGGGGTGGGA
AGGAAAAAACTGGACACTGCCATCTGCTGCCTAGGCCTGGAGGGAAGCCCAAGGCTACTTGG
ACCTCAGGACCTGGAATCTGAGAGGGTGGGTGGCAGAGGGGAGCAGAGCCATCTGCACTATT
GCATAATCTGAGCCAGAGTTTGGGACCAGGACCTCCTGCTTTTCCATACTTAACTGTGGCCT
CAGCATGGGGTAGGGCTGGGTGACTGGGTCTAGCCCCTGATCCCAAATCTGTTTACACATCA
ATCTGCCTCACTGCTGTTCTGGGCCATCCCCATAGCCATGTTTACATGATTTGATGTGCAAT
AGGGTGGGGTAGGGGCAGGGAAAGGACTGGGCCAGGGCAGGCTCGGGAGATAGATTGTCTCC
CTTGCCTCTGGCCCAGCAGAGCCTAAGCACTGTGCTATCCTGGAGGGGCTTTGGACCACCTG
AAAGACCAAGGGGATAGGGAGGAGGAGGCTTCAGCCATCAGCAATAAAGTTGATCCCAGGGA
AAAAAA
```

FIGURE 79

MEAPDYEVLSVREQLFHERIRECIISTLLFATLYILCHIFLTRFKKPAEFTTVDDEDATVNK
IALELCTFTLAIALGAVLLLPFSIISNEVLLSLPRNYYIQWLNGSLIHGLWNLVFLFPNLSL
IFLMPFAYFFTESEGFAGSRKGVLGRVYETVVMLMLLTLLVLGMVWVASAIVDKNKANRESL
YDFWEYYLPYLYSCISFLGVLLLLVCTPLGLARMFSVTGKLLVKPRLLEDLEEQLYCSAFEE
AALTRRICNPTSCWLPLDMELLHRQVLALQTQRVLLEKRRKASAWQRNLGYPLAMLCLLVLT
GLSVLIVAIHILELLIDEAAMPRGMQGTSLGQVSFSKLGSFGAVIQVVLIFYLMVSSVVGFY
SSPLFRSLRPRWHDTAMTQIIGNCVCLLVLSSALPVFSRTLGLTRFDLLGDFGRFNWLGNFY
IVFLYNAAFAGLTTLCLVKTFTAAVRAELIRAFGLDRLPLPVSGFPQASRKTQHQ

FIGURE 80

GGCTGCCGAGGGAAGGCCCCTTGGGTTGGTCTTGGTTGCTTGGCGGCGGCGGNTTCNTCCCC
GCTCGTCCTCCCCGGGCCCAGAGGCACCTCGGCTTCAGTCATGCTGAGCAGAGTATGGAAGC
ACCTGACTACGAAGTGCTATCCGTGCGAGAACAGCTATTCCACGAGAGGATCCGCGAGTGTA
TTATATCAACACTTCTGTTTGCAACACTGTACATCCTCTGCCACATCTTCCTGACCCGCTTC
AAGAAGCCTGCTGAGTTCACCACAGTGGATGATGAAGATGCCACCG

FIGURE 81

```
GACCGACCTTAAAGAGTGGGAGCAAAGGGAGGACAGAGCCTTTTAAAACGAGGCGGTGGTGC
CTGCCCTTTAAGGGCGGGGCGTCCGGACGACTGTATCTGAGCCCCAGACTGCCCCGAGTTTC
TGTCGCAGGCTGCGAGGAAAGGCCCCTAGGCTGGGTCTGGTGCTTGGCGGCGGCGGCTTCCT
CCCCGTTGTCNTCCCCGGGCCCAGAGGCACCTCGGCTTCAGTCATGCTGAGCAGAGTATGGA
AGCACCTGACTACGAAGTGCTATCCGTGCGAGAACAGCTATTCCACGAGAGGATCCGCGAGT
GTATTATATCAACACTTCTGTTTGCAACACTGTACATCNTCTGCCACATCTTCCTGACCCGC
TTCAAGAAGCCTGCTGAGTTCACCACAGTGGATGATGAAGATGCCACCGTCAACAAGATTGC
GCTCGAGCTGTGCACCTTTACCCTGGCAATTGCCCTGGGTGCTGTCCTGCTCCTGCCCTTCT
CCATCATCAGCAATGAGGTGCTGCACTCCC
```

FIGURE 82

GATGTGCTCCTTGGAGCTGGTGTGCAGTGTCCTGACTGTAAGATCAAGTCCAAACCTGTTTT
GGAATTGAGGAAACTTCTCTTTTGATCTCAGCCCTTGGTGGTCCAGGTCTTCATGCTGCTGT
GGGTGATATTACTGGTCCTGGCTCCTGTCAGTGGACAGTTTGCAAGGACACCCAGGCCCATT
ATTTTCCTCCAGCCTCCATGGACCACAGTCTTCCAAGGAGAGAGAGTGACCCTCACTTGCAA
GGGATTTCGCTTCTACTCACCACAGAAAACAAAATGGTACCATCGGTACCTTGGGAAAGAAA
TACTAAGAGAAACCCCAGACAATATCCTTGAGGTTCAGGAATCTGGAGAGTACAGATGCCAG
GCCCAGGGCTCCCCTCTCAGTAGCCCTGTGCACTTGGATTTTTCTTCAGAGATGGGATTTCC
TCATGCTGCCCAGGCTAATGTTGAACTCCTGGGCTCAAGTGATCTGCTCACCTAGGCCTCTC
AAAGCGCTGGGATTACAGCTTCGCTGATCCTGCAAGCTCCACTTTCTGTGTTTGAAGGAGAC
TCTGTGGTTCTGAGGTGCCGGGCAAAGGCGGAAGTAACACTGAATAATACTATTTACAAGAA
TGATAATGTCCTGGCATTCCTTAATAAAGAACTGACTTCCAAAAAAAAAAAAAAAAAAAAA
AAA

FIGURE 83

MLLWVILLVLAPVSGQFARTPRPIIFLQPPWTTVFQGERVTLTCKGFRFYSPQKTKWYHRYL
GKEILRETPDNILEVQESGEYRCQAQGSPLSSPVHLDFSSEMGFPHAAQANVELLGSSDLLT

FIGURE 84

CAGAAGAGGGGGCTAGCTAGCTGTCTCTGCGGACCAGGGAGACCCCCGCGCCCCCCGGTGT
GAGGCGGCCTCACAGGGCCGGGTGGGCTGGCGAGCCGACGCGGCGGCGGAGGAGGCTGTGAG
GAGTGTGTGGAACAGGACCCGGGACAGAGGAACATGGCTCCGCAGAACCTGAGCACCTTTT
GCCTGTTGCTGCTATACCTCATCGGGCGGTGATTGCCGGACGAGATTTCTATAAGATCTTG
GGGGTGCCTCGAAGTGCCTCTATAAAGGATATTAAAAAGGCCTATAGGAAACTAGCCCTGCA
GCTTCATCCCGACCGGAACCCTGATGATCCACAAGCCCAGGAGAAATTCCAGGATCTGGGTG
CTGCTTATGAGGTTCTGTCAGATAGTGAGAAACGGAAACAGTACGATACTTATGGTGAAGAA
GGATTAAAAGATGGTCATCAGAGCTCCCATGGAGACATTTTTTCACACTTCTTTGGGGATTT
TGGTTTCATGTTTGGAGGAACCCCTCGTCAGCAAGACAGAAATATTCCAAGAGGAAGTGATA
TTATTGTAGATCTAGAAGTCACTTTGGAAGAAGTATATGCAGGAAATTTTGTGGAAGTAGTT
AGAAACAAACCTGTGGCAAGGCAGGCTCCTGGCAAACGGAAGTGCAATTGTCGGCAAGAGAT
GCGGACCACCCAGCTGGGCCCTGGGCGCTTCCAAATGACCCAGGAGGTGGTCTGCGACGAAT
GCCCTAATGTCAAACTAGTGAATGAAGAACGAACGCTGGAAGTAGAAATAGAGCCTGGGGTG
AGAGACGGCATGGAGTACCCCTTTATTGGAGAAGGTGAGCCTCACGTGGATGGGGAGCCTGG
AGATTTACGGTTCCGAATCAAAGTTGTCAAGCACCCAATATTTGAAAGGAGAGGAGATGATT
TGTACACAAATGTGACAATCTCATTAGTTGAGTCACTGGTTGGCTTTGAGATGGATATTACT
CACTTGGATGGTCACAAGGTACATATTTCCCGGGATAAGATCACCAGGCCAGGAGCGAAGCT
ATGGAAGAAAGGGGAAGGGCTCCCCAACTTTGACAACAACAATATCAAGGGCTCTTTGATAA
TCACTTTTGATGTGGATTTTCCAAAAGAACAGTTAACAGAGGAAGCGAGAGAAGGTATCAAA
CAGCTACTGAAACAAGGGTCAGTGCAGAAGGTATACAATGGACTGCAAGGATATTGAGAGTG
AATAAAATTGGACTTTGTTTAAAATAAGTGAATAAGCGATATTTATTATCTGCAAGGTTTTT
TTGTGTGTGTTTTTGTTTTTATTTTCAATATGCAAGTTAGGCTTAATTTTTTTATCTAATGA
TCATCATGAAATGAATAAGAGGGCTTAAGAATTTGTCCATTTGCATTCGGAAAAGAATGACC
AGCAAAAGGTTTACTAATACCTCTCCCTTTGGGGATTTAATGTCTGGTGCTGCCGCCTGAGT
TTCAAGAATTAAAGCTGCAAGAGGACTCCAGGAGCAAAAGAAACACAATATAGAGGGTTGGA
GTTGTTAGCAATTTCATTCAAAATGCCAACTGGAGAAGTCTGTTTTAAATACATTTTGTTG
TTATTTTTA

FIGURE 85

MAPQNLSTFCLLLLYLIGAVIAGRDFYKILGVPRSASIKDIKKAYRKLALQLHPDRNPDDPQ
AQEKFQDLGAAYEVLSDSEKRKQYDTYGEEGLKDGHQSSHGDIFSHFFGDFGFMFGGTPRQQ
DRNIPRGSDIIVDLEVTLEEVYAGNFVEVVRNKPVARQAPGKRKCNCRQEMRTTQLGPGRFQ
MTQEVVCDECPNVKLVNEERTLEVEIEPGVRDGMEYPFIGEGEPHVDGEPGDLRFRIKVVKH
PIFERRGDDLYTNVTISLVESLVGFEMDITHLDGHKVHISRDKITRPGAKLWKKGEGLPNFD
NNNIKGSLIITFDVDFPKEQLTEEAREGIKQLLKQGSVQKVYNGLQGY

Important features:

Signal peptide:

amino acids 1-22

Cell attachment sequence.

amino acids 254-257

Nt-dnaJ domain signature.

amino acids 67-87

Homologous region to Nt-dnaJ domain proteins.

amino acids 26-58

N-glycosylation site.

amino acids 5-9, 261-265

Tyrosine kinase phosphorylation site.

amino acids 253-260

N-myristoylation site.

amino acids 18-24, 31-37, 93-99, 215-221

Amidation site.

amino acids 164-168

FIGURE 86

```
TGGGACCAGGGAACCCCGGGCCCCCGGTGGAGNGCCTAACAGGCCGGTGGNTGCGACCGAA
GCGGCGGGCGGAGGAGGTTTTGAGGATTTTTGGAACAGGACCCGGACAGAGGAACCATGGTT
CCGCAGAACNTGAGCACNTTTTGCCTGTTGNTGNTATACTTCATCGGGGCGGTGATTGCCGG
ACGAGATTTNTATAAGATTTTGGGGTGCCTNGAAGTGCCTTNTATAAAGGATATTAAAAAGG
CCTATAGGAAACTAGCCCTGCAGNTTTATCCCGACCGGAACCCTGATGATCCACAAGCCCAG
GAGAAATTCCAGGATTTGGGTGCTGCTTATGAGGTTNTGTCAGATAGTGAGAAACGCAAACA
GTACGATAATTATGGTGAAGAAGGATTAAAAGATGGTNATCAGAGCTCCCATGGAGACATTT
TTTCACACTTNTTTGGGGATTTTGGTTTCATGTTTGGAGGAACCCCTNGTCAGCAAGACAGA
AATATTCCAAGAG
```

FIGURE 87

GGCACGAGGCGGCGGGGCAGTCGCGGGATGCGCCCGGGAGCCACAGCCTGAGGCCCTCAGGT
CTCTGCAGGTGTCGTGGAGGAACCTAGCACCTGCCATCCTCTTCCCCAATTTGCCACTTCCA
GCAGCTTTAGCCCATGAGGAGGATGTGACCGGGACTGAGTCAGGAGCCCTCTGGAAGCATGG
AGACTGTGGTGATTGTTGCCATAGGTGTGCTGGCCACCATCTTTCTGGCTTCGTTTGCAGCC
TTGGTGCTGGTTTGCAGGCAGCGCTACTGCCGGCCGCGAGACCTGCTGCAGCGCTATGATTC
TAAGCCCATTGTGGACCTCATTGGTGCCATGGAGACCCAGTCTGAGCCCTCTGAGTTAGAAC
TGGACGATGTCGTTATCACCAACCCCACATTGAGGCCATTCTGGAGAATGAAGACTGGATC
GAAGATGCCTCGGGTCTCATGTCCCACTGCATTGCCATCTTGAAGATTTGTCACACTCTGAC
AGAGAAGCTTGTTGCCATGACAATGGGCTCTGGGGCCAAGATGAAGACTTCAGCCAGTGTCA
GCGACATCATTGTGGTGGCCAAGCGGATCAGCCCCAGGGTGGATGATGTTGTGAAGTCGATG
TACCCTCCGTTGGACCCCAAACTCCTGGACGCACGGACGACTGCCCTGCTCCTGTCTGTCAG
TCACCTGGTGCTGGTGACAAGGAATGCCTGCCATCTGACGGGAGGCCTGGACTGGATTGACC
AGTCTCTGTCGGCTGCTGAGGAGCATTTGGAAGTCCTTCGAGAAGCAGCCCTAGCTTCTGAG
CCAGATAAAGGCCTCCCAGGCCCTGAAGGCTTCCTGCAGGAGCAGTCTGCAATTTAGTGCCT
ACAGGCCAGCAGCTAGCCATGAAGGCCCCTGCCGCCATCCCTGGATGGCTCAGCTTAGCCTT
CTACTTTTTCCTATAGAGTTAGTTGTTCTCCACGGCTGGAGAGTTCAGCTGTGTGTGCATAG
TAAAGCAGGAGATCCCCGTCAGTTTATGCCTCTTTTGCAGTTGCAAACTGTGGCTGGTGAGT
GGCAGTCTAATACTACAGTTAGGGGAGATGCCATTCACTCTCTGCAAGAGGAGTATTGAAAA
CTGGTGGACTGTCAGCTTTATTTAGCTCACCTAGTGTTTTCAAGAAAATTGAGCCACCGTCT
AAGAAATCAAGAGGTTTCACATTAAAATTAGAATTTCTGGCCTCTCTCGATCGGTCAGAATG
TGTGGCAATTCTGATCTGCATTTTCAGAAGAGGACAATCAATTGAAACTAAGTAGGGGTTTC
TTCTTTTGGCAAGACTTGTACTCTCTCACCTGGCCTGTTTCATTTATTTGTATTATCTGCCT
GGTCCCTGAGGCGTCTGGGTCTCTCCTCTCCTTGCAGGTTTGGGTTTGAAGCTGAGGAACT
ACAAAGTTGATGATTTCTTTTTTATCTTTATGCCTGCAATTTTACCTAGCTACCACTAGGTG
GATAGTAAATTTATACTTATGTTTCCCTCAAAAAAAAAAAAAAA

FIGURE 88

METVVIVAIGVLATIFLASFAALVLVCRQRYCRPRDLLQRYDSKPIVDLIGAMETQSEPSEL
ELDDVVITNPHIEAILENEDWIEDASGLMSHCIAILKICHTLTEKLVAMTMGSGAKMKTSAS
VSDIIVVAKRISPRVDDVVKSMYPPLDPKLLDARTTALLLSVSHLVLVTRNACHLTGGLDWI
DQSLSAAEEHLEVLREAALASEPDKGLPGPEGFLQEQSAI

FIGURE 89

GCTTCATTTCTCCCGACTCAGCTTCCCACCCTGGGCTTTCCGAGGTGCTTTCGCCGCTGTCC
CCACCACTGCAGCCATGATCTCCTTAACGGACACGCAGAAAATTGGAATGGGATTAACAGGA
TTTGGAGTGTTTTTCCTGTTCTTTGGAATGATTCTCTTTTTTGACAAAGCACTACTGGCTAT
TGGAAATGTTTTATTTGTAGCCGGCTTGGCTTTTGTAATTGGTTTAGAAAGAACATTCAGAT
TCTTCTTCCAAAAACATAAAATGAAAGCTACAGGTTTTTTTCTGGGTGGTGTATTTGTAGTC
CTTATTGGTTGGCCTTTGATAGGCATGATCTTCGAAATTTATGGATTTTTTCTCTTGTTCAG
GGGCTTCTTTCCTGTCGTTGTTGGCTTTATTAGAAGAGTGCCAGTCCTTGGATCCCTCCTAAAT
TTACCTGGAATTAGATCATTTGTAGATAAAGTTGGAGAAAGCAACAATATGGTATAACAACA
AGTGAATTTGAAGACTCATTTAAAATATTGTGTTATTTATAAAGTCATTTGAAGAATATTCA
GCACAAAATTAAATTACATGAAATAGCTTGTAATGTTCTTTACAGGAGTTTAAAACGTATAG
CCTACAAAGTACCAGCAGCAAATTAGCAAAGAAGCAGTGAAAACAGGCTTCTACTCAAGTGA
ACTAAGAAGAAGTCAGCAAGCAAACTGAGAGAGGTGAAATCCATGTTAATGATGCTTAAGAA
ACTCTTGAAGGCTATTTGTGTTGTTTTTCCACAATGTGCGAAACTCAGCCATCCTTAGAGAA
CTGTGGTGCCTGTTTCTTTTCTTTTTATTTTGAAGGCTCAGGAGCATCCATAGGCATTTGCT
TTTTAGAAGTGTCCACTGCAATGGCAAAAATATTTCCAGTTGCACTGTATCTCTGGAAGTGA
TGCATGAATTCGATTGGATTGTGTCATTTTAAAGTATTAAAACCAAGGAAACCCCAATTTTG
ATGTATGGATTACTTTTTTTTGNGCNCAGGGCC

FIGURE 90

MISLTDTQKIGMGLTGFGVFFLFFGMILFFDKALLAIGNVLFVAGLAFVIGLERTFRFFFQK
HKMKATGFFLGGVFVVLIGWPLIGMIFEIYGFFLLFRGFFPVVVGFIRRVPVLGSLLNLPGI
RSFVDKVGESNNMV

Important features:

Transmembrane domains:

amino acids 12-30 (typeII), 33-52, 69-89 and 93-109

N-myristoylation sites.

amino acids 11-16, 51-56 and 116-121

Aminoacyl-transfer RNA synthetases class-II protein.

amino acids 49-59

FIGURE 91

```
GAAGACGTGGCGGCTCTCGCCTGGGCTGTTTCCCGGCTTCATTTCTCCCGACTCAGCTTCCC
ACCNTGGGCTTTCCGAGGTGCTTTCGCCGCTGTCCCCACCACTGCAGCCATGATCTCCTTAA
CGGACACGCAGAAAATTGGAATGGGATTAACCGGATTTGGAGTGTTTTTCCTGTTCTTTGGA
ATGATTCTCTTTTTTGACAAAGCACTACTGGCTATTGGAAATGTTTTATTTGTAGCCGGCTT
GGCTTTTGTAATTGGTTTAGAAAGAACATTCAGATTCTTCTTCCAAAAACATAAAATGAAAG
CTACAGGTTTTTTTCTGGGTGGTGTATTTGTAGTCCTTATTGGTTGGCCTTTGATAGGCATG
ATCTTCGAAATTTATGGATTTTTTCTCTTGTTC
```

FIGURE 92

GGCACGAGGCTGAACCCAGCCGGCTCCATCTCAGCTTCTGGTTTCTAAGTCCATGTGCCAAA
GGCTGCCAGGAAGGAGACGCCTTCCTGAGTCCTGGATCTTTCTTCCTTCTGGAAATCTTTGA
CTGTGGGTAGTTATTTATTTCTGAATAAGAGCGTCCACGCATCATGGACCTCGCGGGACTGC
TGAAGTCTCAGTTCCTGTGCCACCTGGTCTTCTGCTACGTCTTTATTGCCTCAGGGCTAATC
ATCAACACCATTCAGCTCTTCACTCTCCTCCTCTGGCCCATTAACAAGCAGCTCTTCCGGAA
GATCAACTGCAGACTGTCCTATTGCATCTCAAGCCAGCTGGTGATGCTGCTGGAGTGGTGGT
CGGGCACGGAATGCACCATCTTCACGGACCCGCGCGCCTACCTCAAGTATGGGAAGGAAAAT
GCCATCGTGGTTCTCAACCACAAGTTTGAAATTGACTTTCTGTGTGGCTGGAGCCTGTCCGA
ACGCTTTGGGCTGTTAGGGGGCTCCAAGGTCCTGGCCAAGAAAGAGCTGGCCTATGTCCCAA
TTATCGGCTGGATGTGGTACTTCACCGAGATGGTCTTCTGTTCGCGCAAGTGGGAGCAGGAT
CGCAAGACGGTTGCCACCAGTTTGCAGCACCTCCGGGACTACCCGAGAAGTATTTTTTCCT
GATTCACTGTGAGGGCACACGGTTCACGGAGAAGAAGCATGAGATCAGCATGCAGGTGGCCC
GGGCCAAGGGGCTGCCTCGCCTCAAGCATCACCTGTTGCCACGAACCAAGGGCTTCGCCATC
ACCGTGAGGAGCTTGAGAAATGTAGTTTCAGCTGTATATGACTGTACACTCAATTTCAGAAA
TAATGAAAATCCAACACTGCTGGGAGTCCTAAACGGAAAGAAATACCATGCAGATTTGTATG
TTAGGAGGATCCCACTGGAAGACATCCCTGAAGACGATGACGAGTGCTCGGCCTGGCTGCAC
AAGCTCTACCAGGAGAAGGATGCCTTTCAGGAGGAGTACTACAGGACGGGCACCTTCCCAGA
GACGCCCATGGTGCCCCCCGGCGGCCCTGGACCCTCGTGAACTGGCTGTTTTGGGCCTCGC
TGGTGCTCTACCCTTTCTTCCAGTTCCTGGTCAGCATGATCAGGAGCGGGTCTTCCCTGACG
CTGGCCAGCTTCATCCTCGTCTTCTTTGTGGCCTCCGTGGGAGTTCGATGGATGATTGGTGT
GACGGAAATTGACAAGGGCTCTGCCTACGGCAACTCTGACAGCAAGCAGAAACTGAATGACT
GACTCAGGGAGGTGTCACCATCCGAAGGGAACCTTGGGGAACTGGTGGCCTCTGCATATCCT
CCTTAGTGGGACACGGTGACAAAGGCTGGGTGAGCCCCTGCTGGGCACGGCGGAAGTCACGA
CCTCTCCAGCCAGGGAGTCTGGTCTCAAGGCCGGATGGGGAGGAAGATGTTTTGTAATCTTT
TTTTCCCCATGTGCTTTAGTGGGCTTTGGTTTTCTTTTTGTGCGAGTGTGTGTGAGAATGGC
TGTGTGGTGAGTGTGAACTTTGTTCTGTGATCATAGAAAGGGTATTTTAGGCTGCAGGGGAG
GGCAGGGCTGGGACCGAAGGGGACAAGTTCCCCTTTCATCCTTTGGTGCTGAGTTTTCTGT
AACCCTTGGTTGCCAGAGATAAAGTGAAAAGTGCTTTAGGTGAGATGACTAAATTATGCCTC
CAAGAAAAAAAAATTAAAGTGCTTTTCTGGGTCAAAAAAAAAAAA

FIGURE 93

MDLAGLLKSQFLCHLVFCYVFIASGLIINTIQLFTLLLWPINKQLFRKINCRLSYCISSQLV
MLLEWWSGTECTIFTDPRAYLKYGKENAIVVLNHKFEIDFLCGWSLSERFGLLGGSKVLAKK
ELAYVPIIGWMWYFTEMVFCSRKWEQDRKTVATSLQHLRDYPEKYFFLIHCEGTRFTEKKHE
ISMQVARAKGLPRLKHHLLPRTKGFAITVRSLRNVVSAVYDCTLNFRNNENPTLLGVLNGKK
YHADLYVRRIPLEDIPEDDDECSAWLHKLYQEKDAFQEEYYRTGTFPETPMVPPRRPWTLVN
WLFWASLVLYPFFQFLVSMIRSGSSLTLASFILVFFVASVGVRWMIGVTEIDKGSAYGNSDS
KQKLND

FIGURE 94

CTGAGGCGGCGGTAGCATGGAGGGGGAGAGTACGTCGGCGGTGCTCTCGGGCTTTGTGCTCG
GCGCACTCGCTTTCCAGCACCTCAACACGGACTCGGACACGGAAGGTTTTCTTCTTGGGGAA
GTAAAAGGTGAAGCCAAGAACAGCATTACTGATTCCCAAATGGATGATGTTGAAGTTGTTTA
TACAATTGACATTCAGAAATATATTCCATGCTATCAGCTTTTTAGCTTTTATAATTCTTCAG
GCGAAGTAAATGAGCAAGCACTGAAGAAATATTATCAAATGTCAAAAGAATGTGGTAGGT
TGGTACAAATTCCGTCGTCATTCAGATCAGATCATGACGTTTAGAGAGAGGCTGCTTCACAA
AAACTTGCAGGAGCATTTTTCAAACCAAGACCTTGTTTTTCTGCTATTAACACCAAGTATAA
TAACAGAAAGCTGCTCTACTCATCGACTGGAACATTCCTTATATAAACCTCAAAAGGACTT
TTTCACAGGGTACCTTTAGTGGTTGCCAATCTGGGCATGTCTGAACAACTGGGTTATAAAC
TGTATCAGGTTCCTGTATGTCCACTGGTTTTAGCCGAGCAGTACAAACACACAGCTCTAAAT
TTTTTGAAGAAGATGGATCCTTAAAGGAGGTACATAAGATAAATGAAATGTATGCTTCATTA
CAAGAGGAATTAAAGAGTATATGCAAAAAAGTGGAAGACAGTGAACAAGCAGTAGATAAACT
AGTAAAGGATGTAAACAGATTAAAACGAGAAATTGAGAAAAGGAGAGGAGCACAGATTCAGG
CAGCAAGAGAGAAGAACATCCAAAAAGACCCTCAGGAGAACATTTTTCTTTGTCAGGCATTA
CGGACCTTTTTTCCAAATTCTGAATTTCTTCATTCATGTGTTATGTCTTTAAAAAATAGACA
TGTTTCTAAAAGTAGCTGTAACTACAACCACCATCTCGATGTAGTAGACAATCTGACCTTAA
TGGTAGAACACACTGACATTCCTGAAGCTAGTCCAGCTAGTACACCACAAATCATTAAGCAT
AAAGCCTTAGACTTAGATGACAGATGGCAATTCAAGAGATCTCGGTTGTTAGATACACAAGA
CAAACGATCTAAAGCAAATACTGGTAGTAGTAACCAAGATAAAGCATCCAAAATGAGCAGCC
CAGAAACAGATGAAGAAATTGAAAAGATGAAGGGTTTTGGTGAATATTCACGGTCTCCTACA
TTTTGATCCTTTTAACCTTACAAGGAGATTTTTTATTTGGCTGATGGGTAAAGCCAAACAT
TTCTATTGTTTTACTATGTTGAGCTACTTGCAGTAAGTTCATTTGTTTTTACTATGTTCAC
CTGTTTGCAGTAATACACAGATAACTCTTAGTGCATTTACTTCACAAAGTACTTTTTCAAAC
ATCAGATGCTTTTATTTCCAAACCTTTTTTTCACCTTTCACTAAGTTGTTGAGGGGAAGGCT
TACACAGACACATTCTTTAGAATTGGAAAAGTGAGACCAGGCACAGTGGCTCACACCTGTAA
TCCCAGCACTTAGGGAAGACAAGTCAGGAGGATTGATTGAAGCTAGGAGTTAGAGACCAGCC
TGGGCAACGTATTGAGACCATGTCTATTAAAAAATAAATGGAAAGCAAGAATAGCCTTAT
TTTCAAAATATGGAAGAAATTTATATGAAAATTTATCTGAGTCATTAAAATTCTCCTTAAG
TGATACTTTTTTAGAAGTACATTATGGCTAGAGTTGCCAGATAAAATGCTGGATATCATGCA
ATAAATTTGCAAAACATCATCTAAATTTAAAAAAAAAAAAAAAAAAAAA

FIGURE 95

MEGESTSAVLSGFVLGALAFQHLNTDSDTEGFLLGEVKGEAKNSITDSQMDDVEVVYTIDIQ
KYIPCYQLFSFYNSSGEVNEQALKKILSNVKKNVVGWYKFRRHSDQIMTFRERLLHKNLQEH
FSNQDLVFLLLTPSIITESCSTHRLEHSLYKPQKGLFHRVPLVVANLGMSEQLGYKTVSGSC
MSTGFSRAVQTHSSKFFEEDGSLKEVHKINEMYASLQEELKSICKKVEDSEQAVDKLVKDVN
RLKREIEKRRGAQIQAAREKNIQKDPQENIFLCQALRTFFPNSEFLHSCVMSLKNRHVSKSS
CNYNHHLDVVDNLTLMVEHTDIPEASPASTPQIIKHKALDLDDRWQFKRSRLLDTQDKRSKA
NTGSSNQDKASKMSSPETDEEIEKMKGFGEYSRSPTF

FIGURE 96

```
GGCACAGCCGCGCGGCGGAGGGCAGAGTCAGCCGAGCCGAGTCCAGCCGGACGAGCGGACCAGCGCAGGGCAGC
CCAAGCAGCGCGCAGCGAACGCCCGCCGCCGCCCACACCCTCTGCGGTCCCCGCGGCGCCTGCCACCCTTCCCT
CCTTCCCCGCGTCCCCGCCTCGCCGGCCAGTCAGCTTGCCGGGTTCGCTGCCCCGCGAAACCCCGAGGTCACCA
GCCCGCGCCTCTGCTTCCCTGGGCCGCGCGCCGCCTCCACGCCCTCCTTCTCCCCTGGCCCGGCGCCTGGCACC
GGGGACCGTTGCCTGACGCGGAGGCCCAGCTCTACTTTTCGCCCCGCGTCTCCTCCGCCTGCTCGCCTCTTCCAC
CAACTCCAACTCCTTCTCCCTCCAGCTCCACTCGCTAGTCCCCGACTCCGCCAGCCCTCGGCCCGCTGCCGTAG
CGCCGCTTCCCGTCCGGTCCCAAAGGTGGGAACGCGTCCGCCCCGGCCCGCACCATGGCACGGTTCGGCTTGCC
CGCGCTTCTCTGCACCCTGGCAGTGCTCAGCGCCGCGCTGCTGGCTGCCGAGCTCAAGTCGAAAAGTTGCTCGG
AAGTGCGACGTCTTTACGTGTCCAAAGGCTTCAACAAGAACGATGCCCCCCTCCACGAGATCAACGGTGATCAT
TTGAAGATCTGTCCCCAGGGTTCTACCTGCTGCTCTCAAGAGATGGAGGAGAAGTACAGCCTGCAAAGTAAAGA
TGATTTCAAAAGTGTGGTCAGCGAACAGTGCAATCATTTGCAAGCTGTCTTTGCTTCACGTTACAAGAAGTTTG
ATGAATTCTTCAAAGAACTACTTGAAAATGCAGAGAAATCCCTGAATGATATGTTTGTGAAGACATATGGCCAT
TTATACATGCAAAATTCTGAGCTATTTAAAGATCTCTTCGTAGAGTTGAAACGTTACTACGTGGTGGGAAATGT
GAACCTGGAAGAAATGCTAAATGACTTCTGGGCTCGCCTCCTGGAGCGGATGTTCCGCCTGGTGAACTCCAGT
ACCACTTTACAGATGAGTATCTGGAATGTGTGAGCAAGTATACGGAGCAGCTGAAGCCCTTCGGAGATGTCCCT
CGCAAATTGAAGCTCCAGGTTACTCGTGCTTTTGTAGCAGCCCGTACTTTCGCTCAAGGCTTAGCGGTTGCGGG
AGATGTCGTGAGCAAGGTCTCCGTGGTAAACCCCACAGCCCAGTGTACCCATGCCCTGTTGAAGATGATCTACT
GCTCCCACTGCCGGGGTCTCGTGACTGTGAAGCCATGTTACAACTACTGCTCAAACATCATGAGAGGCTGTTTG
GCCAACCAAGGGGATCTCGATTTTGAATGGAACAATTTCATAGATGCTATGCTGATGGTGGCAGAGAGGCTAGA
GGGTCCTTTCAACATTGAATCGGTCATGGATCCCATCGATGTGAAGATTTCTGATGCTATTATGAACATGCAGG
ATAATAGTGTTCAAGTGTCTCAGAAGGTTTTCCAGGGATGTGGACCCCCCAAGCCCCTCCCAGCTGGACGAATT
TCTCGTTCCATCTCTGAAAGTGCCTTCAGTGCTCGCTTCAGACCACATCACCCCGAGGAACGCCCAACCACAGC
AGCTGGCACTAGTTTGGACCGACTGGTTACTGATGTCAAGGAGAAACTGAAACAGGCCAAGAAATTCTGGTCCT
CCCTTCCGAGCAACGTTTGCAACGATGAGAGGATGGCTGCAGGAAACGGCAATGAGGATGACTGTTGGAATGGG
AAAGGCAAAAGCAGGTACCTGTTTGCAGTGACAGGGAAATGGATTAGCCAACCAGGGCAACAACCCAGAGGTCCA
GGTTGACACCAGCAAACCAGACATACTGATCCTTCGTCAAATCATGGCTCTTCGAGTGATGACCAGCAAGATGA
AGAATGCATACAATGGGAACGACGTGGACTTCTTTGATATCAGTGATGAAAGTAGTGGAGAAGGAAGTGGAAGT
GGCTGTGAGTATCAGCAGTGCCCTTCAGAGTTTGACTACAATGCCACTGACCATGCTGGGAAGAGTGCCAATGA
GAAAGCCGACAGTGCTGGTGTCCGTCCTGGGGCACAGGCCTACCTCCTCACTGTCTTCTGCATCTTGTTCCTGG
TTATGCAGAGAGAGTGGAGATAATTCTCAAACTCTGAGAAAAAGTGTTCATCAAAAAGTTAAAAGGCACCAGTT
ATCACTTTTCTACCATCCTAGTGACTTTGCTTTTTAAATGAATGGACAACAATGTACAGTTTTTACTATGTGGC
CACTGGTTTAAGAAGTGCTGACTTTGTTTTCTCATTCAGTTTTGGGAGGAAAAGGGACTGTGCATTGAGTTGGT
TCCTGCTCCCCCAAACCATGTTAAACGTGGCTAACAGTGTAGGTACAGAACTATAGTTAGTTGTGCATTTGTGA
TTTTATCACTCTATTATTTGTTTGTATGTTTTTTTCTCATTTCGTTTGTGGGTTTTTTTTTCCAACTGTGATCT
CGCCTTGTTTCTTACAAGCAAACCAGGGTCCCTTCTTGGCACGTAACATGTACGTATTTCTGAAATATTAAATA
GCTGTACAGAAGCAGGTTTTATTTATCATGTTATCTTATTAAAAGAAAAAGCCCAAAAAGC
```

FIGURE 97

MARFGLPALLCTLAVLSAALLAAELKSKSCSEVRRLYVSKGFNKNDAPLHEINGDHLKICPQ
GSTCCSQEMEEKYSLQSKDDFKSVVSEQCNHLQAVFASRYKKFDEFFKELLENAEKSLNDMF
VKTYGHLYMQNSELFKDLFVELKRYYVVGNVNLEEMLNDFWARLLERMFRLVNSQYHFTDEY
LECVSKYTEQLKPFGDVPRKLKLQVTRAFVAARTFAQGLAVAGDVVSKVSVVNPTAQCTHAL
LKMIYCSHCRGLVTVKPCYNYCSNIMRGCLANQGDLDFEWNNFIDAMLMVAERLEGPFNIES
VMDPIDVKISDAIMNMQDNSVQVSQKVFQGCGPPKPLPAGRISRSISESAFSARFRPHHPEE
RPTTAAGTSLDRLVTDVKEKLKQAKKFWSSLPSNVCNDERMAAGNGNEDDCWNGKGKSRYLF
AVTGNGLANQGNNPEVQVDTSKPDILILRQIMALRVMTSKMKNAYNGNDVDFFDISDESSGE
GSGSGCEYQQCPSEFDYNATDHAGKSANEKADSAGVRPGAQAYLLTVFCILFLVMQREWR

FIGURE 98

CTCGCCCTCAAATGGGAACGCTGGCCTGGGACTAAAGCATAGACCACCAGGCTGAGTATCCT
GACCTGAGTCATCCCCAGGGATCAGGAGCCTCCAGCAGGGAACCTTCCATTATATTCTTCAA
GCAACTTACAGCTGCACCGACAGTTGCGATGAAAGTTCTAATCTCTTCCCTCCTCCTGTTGC
TGCCACTAATGCTGATGTCCATGGTCTCTAGCAGCCTGAATCCAGGGGTCGCCAGAGGCCAC
AGGGACCGAGGCCAGGCTTCTAGGAGATGGCTCCAGGAAGGCGGCCAAGAATGTGAGTGCAA
AGATTGGTTCCTGAGAGCCCCGAGAAGAAAATTCATGACAGTGTCTGGGCTGCCAAAGAAGC
AGTGCCCCTGTGATCATTTCAAGGGCAATGTGAAGAAAACAAGACACCAAAGGCACCACAGA
AAGCCAAACAAGCATTCCAGAGCCTGCCAGCAATTTCTCAAACAATGTCAGCTAAGAAGCTT
TGCTCTGCCTTTGTAGGAGCTCTGAGCGCCCACTCTTCCAATTAAACATTCTCAGCCAAGAA
GACAGTGAGCACACCTACCAGACACTCTTCTTCTCCCACCTCACTCTCCACTGTACCCACC
CCTAAATCATTCCAGTGCTCTCAAAAAGCATGTTTTTCAAGATCATTTGTTTGTTGCTCTC
TCTAGTGTCTTCTTCTCTCGTCAGTCTTAGCCTGTGCCCTCCCCTTACCCAGGCTTAGGCTT
AATTACCTGAAAGATTCCAGGAAACTGTAGCTTCCTAGCTAGTGTCATTTAACCTTAAATGC
AATCAGGAAAGTAGCAAACAGAAGTCAATAAATATTTTAAATGTCAAAAAAAAAAAAAAAAA

FIGURE 99

MKVLISSLLLLLPLMLMSMVSSSLNPGVARGHRDRGQASRRWLQEGGQECECKDWFLRAPRR
KFMTVSGLPKKQCPCDHFKGNVKKTRHQRHHRKPNKHSRACQQFLKQCQLRSFALPL

FIGURE 100

AATGGCTGTCTTAGTACTTCGCCTGACAGTTGTCCTGGGACTGCTTGTCTTATTCCTGACCT
GCTATGCAGACGACAAACCAGACAAGCCAGACGACAAGCCAGACGACTCGGGCAAAGACCCA
AAGCCAGACTTCCCCAAATTCCTAAGCCTCCTGGGCACAGAGATCATTGAGAATGCAGTCGA
GTTCATCCTCCGCTCCATGTCCAGGAGCACAGGATTTATGGAATTTGATGATAATGAAGGAA
AACATTCATCAAAGTGACATCCTCAGGACACACCCATGTGGCTCCTGGACAATCCAAGAGCA
GCCAAATCCTGCTTTTCCAGTTTGGCTCCACAAGTCCTCCAGGACAGAGCCCTCAAAGCAAC
TCCCAACGAGTTCTCAGGATTCAGGCTCTGGCTTCAACCAAACAGAACTCATTTTGAACACC
CTGACTGCATTTTTGCTTTTAGAAAGTTAGAATAAATATGGCGCTTTGGGATCACATAGTTG
ATGGAGAGGAAAAAAAAAAAAAAAAAAAAAAAAAAAAAAAAAAAAAAAAAAAA

FIGURE 101

MAVLVLRLTVVLGLLVLFLTCYADDKPDKPDDKPDDSGKDPKPDFPKFLSLLGTEIIENAVE
FILRSMSRSTGFMEFDDNEGKHSSK

FIGURE 102

```
GGACGCCAGCGCCTGCAGAGGCTGAGCAGGGAAAAAGCCAGTGCCCCAGCGGAAGCACAGCT
CAGAGCTGGTCTGCCATGGACATCCTGGTCCCACTCCTGCAGCTGCTGGTGCTGCTTCTTAC
CCTGCCCCTGCACCTCATGGCTCTGCTGGGCTGCTGGCAGCCCCTGTGCAAAAGCTACTTCC
CCTACCTGATGGCCGTGCTGACTCCCAAGAGCAACCGCAAGATGGAGAGCAAGAAACGGGAG
CTCTTCAGCCAGATAAAGGGGCTTACAGGAGCCTCCGGGAAAGTGGCCCTACTGGAGCTGGG
CTGCGGAACCGGAGCCAACTTTCAGTTCTACCCACCGGGCTGCAGGGTCACCTGCCTAGACC
CAAATCCCCACTTTGAGAAGTTCCTGACAAAGAGCATGGCTGAGAACAGGCACCTCCAATAT
GAGCGGTTTGTGGTGGCTCCTGGAGAGGACATGAGACAGCTGGCTGATGGCTCCATGGATGT
GGTGGTCTGCACTCTGGTGCTGTGCTCTGTGCAGAGCCCAAGGAAGGTCCTGCAGGAGGTCC
GGAGAGTACTGAGACCGGGAGGTGTGCTCTTTTTCTGGGAGCATGTGGCAGAACCATATGGA
AGCTGGGCCTTCATGTGGCAGCAAGTTTTCGAGCCCACCTGGAAACACATTGGGGATGGCTG
CTGCCTCACCAGAGAGACCTGGAAGGATCTTGAGAACGCCCAGTTCTCCGAAATCCAAATGG
AACGACAGCCCCCTCCCTTGAAGTGGCTACCTGTTGGGCCCCACATCATGGGAAAGGCTGTC
AAACAATCTTTCCCAAGCTCCAAGGCACTCATTTGCTCCTTCCCCAGCCTCCAATTAGAACA
AGCCACCCACCAGCCTATCTATCTTCCACTGAGAGGGACCTAGCAGAATGAGAGAAGACATT
CATGTACCACCTACTAGTCCCTCTCTCCCCAACCTCTGCCAGGGCAATCTCTAACTTCAATC
CCGCCTTCGACAGTGAAAAAGCTCTACTTCTACGCTGACCCAGGGAGGAAACACTAGGACCC
TGTTGTATCCTCAACTGCAAGTTTCTGGACTAGTCTCCCAACGTTTGCCTCCCAATGTTGTC
CCTTTCCTTCGTTCCCATGGTAAAGCTCCTCTCGCTTTCCTCCTGAGGCTACACCCATGCGT
CTCTAGGAACTGGTCACAAAAGTCATGGTGCCTGCATCCCTGCCAAGCCCCCTGACCCTCT
CTCCCCACTACCACCTTCTTCCTGAGCTGGGGGCACCAGGGAGAATCAGAGATGCTGGGGAT
GCCAGAGCAAGACTCAAAGAGGCAGAGGTTTTGTTCTCAAATATTTTTTAATAAATAGACGA
AACCACG
```

FIGURE 103

MDILVPLLQLLVLLLTLPLHLMALLGCWQPLCKSYFPYLMAVLTPKSNRKMESKKRELFSQI
KGLTGASGKVALLELGCGTGANFQFYPPGCRVTCLDPNPHFEKFLTKSMAENRHLQYERFVV
APGEDMRQLADGSMDVVVCTLVLCSVQSPRKVLQEVRRVLRPGGVLFFWEHVAEPYGSWAFM
WQQVFEPTWKHIGDGCCLTRETWKDLENAQFSEIQMERQPPPLKWLPVGPHIMGKAVKQSFP
SSKALICSFPSLQLEQATHQPIYLPLRGT

FIGURE 104

```
GTGGGATTTATTTGAGTGCAAGATCGTTTTCTCAGTGGTGGTGGAAGTTGCCTCATCGCAGG
CAGATGTTGGGGCTTTGTCCGAACAGCTCCCCTCTGCCAGCTTCTGTAGATAAGGGTTAAAA
ACTAATATTTATATGACAGAAGAAAAAGATGTCATTCCGTAAAGTAAACATCATCATCTTGG
TCCTGGCTGTTGCTCTCTTCTTACTGGTTTTGCACCATAACTTCCTCAGCTTGAGCAGTTTG
TTAAGGAATGAGGTTACAGATTCAGGAATTGTAGGGCCTCAACCTATAGACTTTGTCCCAAA
TGCTCTCCGACATGCAGTAGATGGGAGACAAGAGGAGATTCCTGTGGTCATCGCTGCATCTG
AAGACAGGCTTGGGGGGGCCATTGCAGCTATAAACAGCATTCAGCACAACACTCGCTCCAAT
GTGATTTTCTACATTGTTACTCTCAACAATACAGCAGACCATCTCCGGTCCTGGCTCAACAG
TGATTCCCTGAAAAGCATCAGATACAAAATTGTCAATTTTGACCCTAAACTTTTGGAAGGAA
AAGTAAAGGAGGATCCTGACCAGGGGGAATCCATGAAACCTTTAACCTTTGCAAGGTTCTAC
TTGCCAATTCTGGTTCCCAGCGCAAAGAAGGCCATATACATGGATGATGATGTAATTGTGCA
AGGTGATATTCTTGCCCTTTACAATACAGCACTGAAGCCAGGACATGCAGCTGCATTTTCAG
AAGATTGTGATTCAGCCTCTACTAAAGTTGTCATCCGTGGAGCAGGAAACCAGTACAATTAC
ATTGGCTATCTTGACTATAAAAGGAAGAATTCGTAAGCTTTCCATGAAAGCCAGCACTTG
CTCATTTAATCCTGGAGTTTTTGTTGCAAACCTGACGGAATGGAAACGACAGAATATAACTA
ACCAACTGGAAAAATGGATGAAACTCAATGTAGAAGAGGGACTGTATAGCAGAACCCTGGCT
GGTAGCATCACAACACCTCCTCTGCTTATCGTATTTTATCAACAGCACTCTACCATCGATCC
TATGTGGAATGTCCGCCACCTTGGTTCCAGTGCTGGAAAACGATATTCACCTCAGTTTGTAA
AGGCTGCCAAGTTACTCCATTGGAATGGACATTTGAAGCCATGGGGAAGGACTGCTTCATAT
ACTGATGTTTGGGAAAAATGGTATATTCCAGACCCAACAGGCAAATTCAACCTAATCCGAAG
ATATACCGAGATCTCAAACATAAAGTGAAACAGAATTTGAACTGTAAGCAAGCATTTCTCAG
GAAGTCCTGGAAGATAGCATGCATGGGAAGTAACAGTTGCTAGGCTTCAATGCCTATCGGTA
GCAAGCCATGGAAAAGATGTGTCAGCTAGGTAAAGATGACAAACTGCCCTGTCTGGCAGTC
AGCTTCCCAGACAGACTATAGACTATAAATATGTCTCCATCTGCCTTACCAAGTGTTTTCTT
ACTACAATGCTGAATGACTGGAAGAAGAACTGATATGGCTAGTTCAGCTAGCTGGTACAGA
TAATTCAAAACTGCTGTTGGTTTTAATTTTGTAACCTGTGGCCTGATCTGTAAATAAAACTT
ACATTTTTC
```

FIGURE 105

MSFRKVNIIILVLAVALFLLVLHHNFLSLSSLLRNEVTDSGIVGPQPIDFVPNALRHAVDGR
QEEIPVVIAASEDRLGGAIAAINSIQHNTRSNVIFYIVTLNNTADHLRSWLNSDSLKSIRYK
IVNFDPKLLEGKVKEDPDQGESMKPLTFARFYLPILVPSAKKAIYMDDDVIVQGDILALYNT
ALKPGHAAAFSEDCDSASTKVVIRGAGNQYNYIGYLDYKKERIRKLSMKASTCSFNPGVFVA
NLTEWKRQNITNQLEKWMKLNVEEGLYSRTLAGSITTPPLLIVFYQQHSTIDPMWNVRHLGS
SAGKRYSPQFVKAAKLLHWNGHLKPWGRTASYTDVWEKWYIPDPTGKFNLIRRYTEISNIK

FIGURE 106

TGGTTTTTGCCCCATAAATTCCCTCAGCTTGAGCAGTTTGTTAAGGAATGAGGTTACAGATT
CAGGAATTNTAGGNCCTCAACCTNTAGANTTTGTCCCAAATGTTCTCCGACATGCAGTAGAT
GGGAGACAAGAGGAGATTCCTGTGGTCATCGCTGCATNTGAAGACAGGCTTGGGGGGGCCAT
TGCAGCTATAAACAGCATTCAGCACAACACTCGNTCCAATGTGATTTTCTACATTGTTACTC
TCAACAATACAGCAGACCATNTCCGGTCCTGGNTCAACAGTGATTCCCTGAAAAGCATCAGA
TACAAAATTGTCAATTTTGACCCTAAACTTTTGGAAGGAAAAGTAAAGGAGGATCCTGACCA
GGGGGAATCCATGAAACCTTTAACCTTTGCAAGGTTCTACTTGCCAATTCTGGTTCCCAGCG
CAAAGAAGGCCATATACATGGATGATGATGTAATTGTGCAAGGTGATATTCTTGCCCTTTAC
AATACAGCACTGAAGCCAGGACATGCAGCTGCATTTTCAGAAGATTGTGATTCAGCCTCTAC
TAAAGTTGTCATCCGTGGAGCAGGAAA

FIGURE 107

```
CGACGCTCTAGCGGTTACCGCTGCGGGCTGGCTGGGCGTAGTGGGGCTGCGCGGCTGCCACG
GAGCTAGAGGGCAAGTGTGCTCGGCCCAGCGTGCAGGGAACGCGGGCGGCCAGACAACGGGC
TGGGCTCCGGGGCCTGCGGCGCGGGCGCTGAGCTGGCAGGGCGGGTCGGGGCGCGGGCTGCA
TCCGCATCTCCTCCATCGCCTGCAGTAAGGGCGGCCGCGGCGAGCCTTTGAGGGGAACGACT
TGTCGGAGCCCTAACCAGGGGTGTCTCTGAGCCTGGTGGGATCCCCGGAGCGTCACATCACT
TTCCGATCACTTCAAAGTGGTTAAAAACTAATATTTATATGACAGAAGAAAAGATGTCATT
CCGTAAAGTAAACATCATCATCTTGGTCCTGGGCTGTTGCTCTCTTCTTACTGGTTTTGCAC
CATAACTTCCTCAGCTTGAGGCAGTTTGTTAAGGAATGAGGTTACAGATTCAGGAATTGTAG
GGCCTCAACCTATAGGACTTTGTCCCAAATGCTCTCCGACATGCAGTAGATGGGAGACAAGA
GGAGATTCCTGTGGTCATCGCTGCATCTGAAGACAGGCTTGGGGGGGCCATTGCAGCTATAA
ACAGCATTCAGCACAACACTCGCTCCAATGTGATTTTCTACATTGTTACTCTCAACAATACA
GCAGACCATCTCCGGTCCTGGGCTCAACAGTGATTCCCTGAAAAGCATCAGATACAAAATTG
TCAATTTTGACCCTAAACTTTTGGAAGGAAAAGTAAAGGAGGATCCTGACCAGGGGAATCC
ATGAAACCTTTAACCTTTGCAAGGTTCTACTTGCCAATTCTGGGTTCCCAGCGCAAAGAAGG
CCATATACATGGATGATGATGTAATTGTGCAAGGTGATATTCTTGCCCTTTACAATACAGCA
CTGAAGCCAGGACATGCAGCTGCATTTTCAGAAGATTGTGATTCAGCCTCTACTAAAGTTGT
CATCCGTGGAGCAGGAAACCAGTACAATTACATTGGCTATCTTGACTATAAAAAGGAAAGAA
TTCGTAAGCTTTCCATGAAAGCCAGCACTTGCTCATTTAATCCTGGAGTTTTTGTTGCAAAC
CTGACGGAATGGAAACGACAGAATATAACTAACCAACTGGAAAAATGGATGAAACTCAATGT
AGAAGAGGGACTGTATAGCAGAACCCTGGCTGGTAGCATCACAACACCTCCTCTGCTTATCG
TATTTTATCAACAGCACTCTACCATCGATCCTATGTGGAATGTCCGCCACCTTGGTTCCAGT
GCTGGAAAACGATATTCACCTCAGTTTGTAAAGGCTGCCAAGTTACTCCATTGGAATGGACA
TTTGAAGCCATGGGGAAGGACTGCTTCATATACTGATGTTTGGGGAAAAATGGTATATTCCA
GACCCAACAGGCAAATTCAACCTAATCCGAAGATATACCGAGATCTCAAACATAAAGTGAAA
CAGAATTTGAACTGTAAGCAAGCATTTCTCAGGAAGTCCTGGAAGATAGCATGCGTGGGAAG
TAACAGTTGCTAGGCTTCAATGCCTATCGGTAGCAAGCCATGGAAAAAGATGTGTCAGCTAG
GTAAAGATGACAAACTGCCCTGTCTGGCAGTCAGCTTCCCAGACAGACTATAGACTATAAAT
ATGTCTCCATCTGCCTTACCAAGTGTTTTCTTACTACAATGCTGAATGACTGGAAGAAGAA
CTGATATGGCTAGTTCAGCTAGCTGGTACAGATAATTCAAAACTGCTGTTGGTTTTAATTTT
GTAACCTGTGGCCTGATCTGTAAATAAAACTTACATTTTTCAATAGGTAAAAAAAAAAAAA
AAAAAA
```

FIGURE 108

CTGCAGGTAGACATCTCCACTGCCCAGGAATCACTGAGCGTGCAGACAGCACAGCCTCCTCT
GAAGGCCGGCCATACCAGAGTCCTGCCTCGGCATGGGCCTCACCATTGAGGCAGCTCCACTG
TCTGTGCTGGTCTGAGGGTGCTGCCTGTCATGGGGGCAGCCATCTCCCAGGGGGCCCTCATC
GCCATCGTCTGCAACGGTCTCGTGGGCTTCTTGCTGCTGCTGCTCTGGGTCATCCTCTGCTG
GGCCTGCCATTCTCGTCTGCCGACGTTGACTCTCTCTCTGAATCCAGTCCCAACTCCAGCCC
TGGCCCCTGTCCTGAGAAGGCCCCACCACCCCAGAAGCCCAGCCATGAAGGCAGCTACCTGC
TGCAGCCCTGAAGGCCCCTGGCCTAGCCTGGAGCCCAGGACCTAAGTCCACCTCACCTAGAG
CCTGGAATTAGGATCCCAGAGTTCAGCCAGCCTGGGGTCCAGAACTCAAGAGTCCGCCTGCT
TGGAGCTGGACCCAGCGGCCCAGAGTCTAGCCAGCTTGGCTCCAATAGGAGCTCAGTGGCCC
TAAGGAGATGGGCCTGGGGTGGGGGCTTATGAGTTGGTGCTAGAGCCAGGGCCATCTGGACT
ATGCTCCATCCCAAGGGCCAAGGGTCAGGGGCCGGGTCCACTCTTTCCCTAGGCTGAGCACC
TCTAGGCCCTCTAGGTTGGGGAAGCAAACTGGAACCCATGGCAATAATAGGAGGGTGTCCAG
GCTGGGCCCCTCCCCTGGTCCTCCCAGTGTTTGCTGGATAATAAATGGAACTATGGCTCTAA
AAAAAAAAAAAAAAAAA

FIGURE 109

MGAAISQGALIAIVCNGLVGFLLLLLWVILCWACHSRLPTLTLSLNPVPTPALAPVLRRPHH
PRSPAMKAATCCSPEGPWPSLEPRT

FIGURE 110

```
GTTTGAATTCCTTCAACTATACCCACAGTCCAAAAGCAGACTCACTGTGTCCCAGGCTACCA
GTTCCTCCAAGCAAGTCATTTCCCTTATTTAACCGATGTGTCCCTCAAACACCTGAGTGCTA
CTCCCTATTTGCATCTGTTTTGATAAATGATGTTGACACCCTCCACCGAATTCTAAGTGGAA
TCATGTCGGGAAGAGATACAATCCTTGGCCTGTGTATCCTCGCATTAGCCTTGTCTTTGGCC
ATGATGTTTACCTTCAGATTCATCACCACCCTTCTGGTTCACATTTTCATTTCATTGGTTAT
TTTGGGATTGTTGTTTGTCTGCGGTGTTTTATGGTGGCTGTATTATGACTATACCAACGACC
TCAGCATAGAATTGGACACAGAAAGGGAAAATATGAAGTGCGTGCTGGGGTTTGCTATCGTA
TCCACAGGCATCACGGCAGTGCTGCTCGTCTTGATTTTGTTCTCAGAAAGAGAATAAAATT
GACAGTTGAGCTTTTCCAAATCACAAATAAAGCCATCAGCAGTGCTCCCTTCCTGCTGTTCC
AGCCACTGTGGACATTTGCCATCCTCATTTTCTTCTGGGTCCTCTGGGTGGCTGTGCTGCTG
AGCCTGGGAACTGCAGGAGCTGCCCAGGTTATGGAAGGCGGCCAAGTGGAATATAAGCCCCT
TTCGGGCATTCGGTACATGTGGTCGTACCATTTAATTGGCCTCATCTGGACTAGTGAATTCA
TCCTTGCGTGCCAGCAAATGACTATAGCTGGGGCAGTGGTTACTTGTTATTTCAACAGAAGT
AAAAATGATCCTCCTGATCATCCCATCCTTTCGTCTCTCTCCATTCTCTTCTTCTACCATCA
AGGAACCGTTGTGAAAGGGTCATTTTTAATCTCTGTGGTGAGGATTCCGAGAATCATTGTCA
TGTACATGCAAAACGCACTGAAAGAACAGCAGCATGGTGCATTGTCCAGGTACCTGTTCCGA
TGCTGCTACTGCTGTTTCTGGTGTCTTGACAAATACCTGCTCCATCTCAACCAGAATGCATA
TACTACAACTGCTATTAATGGGACAGATTTCTGTACATCAGCAAAAGATGCATTCAAAATCT
TGTCCAAGAACTCAAGTCACTTTACATCTATTAACTGCTTTGGAGACTTCATAATTTTTCTA
GGAAAGGTGTTAGTGGTGTGTTTCACTGTTTTGGAGGACTCATGGCTTTTAACTACAATCG
GGCATTCCAGGTGTGGGCAGTCCCTCTGTTATTGGTAGCTTTTTTTGCCTACTTAGTAGCCC
ATAGTTTTTTATCTGTGTTTGAAACTGTGCTGGATGCACTTTTCCTGTGTTTTGCTGTTGAT
CTGGAAACAAATGATGGATCGTCAGAAAAGCCCTACTTTATGGATCAAGAATTTCTGAGTTT
CGTAAAAAGGAGCAACAAATTAAACAATGCAAGGGCACAGCAGGACAAGCACTCATTAAGGA
ATGAGGAGGGAACAGAACTCCAGGCCATTGTGAGATAGATACCCATTTAGGTATCTGTACCT
GGAAAACATTTCCTTCTAAGAGCCATTTACAGAATAGAAGATGAGACCACTAGAGAAAAGTT
AGTGAATTTTTTTTAAAAGACCTAATAAACCCTATTCTTCCTCAAAA
```

FIGURE 111

MSGRDTILGLCILALALSLAMMFTFRFITTLLVHIFISLVILGLLFVCGVLWWLYYDYTNDL
SIELDTERENMKCVLGFAIVSTGITAVLLVLIFVLRKRIKLTVELFQITNKAISSAPFLLFQ
PLWTFAILIFFWVLWVAVLLSLGTAGAAQVMEGGQVEYKPLSGIRYMWSYHLIGLIWTSEFI
LACQQMTIAGAVVTCYFNRSKNDPPDHPILSSLSILFFYHQGTVVKGSFLISVVRIPRIIVM
YMQNALKEQQHGALSRYLFRCCYCCFWCLDKYLLHLNQNAYTTTAINGTDFCTSAKDAFKIL
SKNSSHFTSINCFGDFIIFLGKVLVVCFTVFGGLMAFNYNRAFQVWAVPLLLVAFFAYLVAH
SFLSVFETVLDALFLCFAVDLETNDGSSEKPYFMDQEFLSFVKRSNKLNNARAQQDKHSLRN
EEGTELQAIVR

FIGURE 112

```
GTTCGATTAGCTCCTCTGAGAAGAAGAGAAAAGGTTCTTGGACCTCTCCCTGTTTCTTCCTT
AGAATAATTTGTATGGGATTTGTGATGCAGGAAAGCCTAAGGGAAAAAGAATATTCATTCTG
TGTGGTGAAAATTTTTTGAAAAAAAAATTGCCTTCTTCAAACAAGGGTGTCATTCTGATATT
TATGAGGACTGTTGTTCTCACTATGAAGGCATCTGTTATTGAAATGTTCCTTGTTTTGCTGG
TGACTGGAGTACATTCAAACAAAGAAACGGCAAAGAAGATTAAAAGGCCCAAGTTCACTGTG
CCTCAGATCAACTGCGATGTCAAAGCCGGAAAGATCATCGATCCTGAGTTCATTGTGAAATG
TCCAGCAGGATGCCAAGACCCCAAATACCATGTTTATGGCACTGACGTGTATGCATCCTACT
CCAGTGTGTGTGGCGCTGCCGTACACAGTGGTGTGCTTGATAATTCAGGAGGGAAAATACTT
GTTCGGAAGGTTGCTGGACAGTCTGGTTACAAAGGGAGTTATTCCAACGGTGTCCAATCGTT
ATCCCTACCACGATGGAGAGAATCCTTTATCGTCTTAGAAAGTAAACCCAAAAAGGGTGTAA
CCTACCCATCAGCTCTTACATACTCATCATCGAAAAGTCCAGCTGCCCAAGCAGGTGAGACC
ACAAAAGCCTATCAGAGGCCACCTATTCCAGGGACAACTGCACAGCCGGTCACTCTGATGCA
GCTTCTGGCTGTCACTGTAGCTGTGGCCACCCCCACCACCTTGCCAAGGCCATCCCCTTCTG
CTGCTTCTACCACCAGCATCCCCAGACCACAATCAGTGGGCCACAGGAGCCAGGAGATGGAT
CTCTGGTCCACTGCCACCTACACAAGCAGCCAAAACAGGCCCAGAGCTGATCCAGGTATCCA
AAGGCAAGATCCTTCAGGAGCTGCCTTCCAGAAACCTGTTGGAGCGGATGTCAGCCTGGGAC
TTGTTCCAAAAGAAGAATTGAGCACACAGTCTTTGGAGCCAGTATCCCTGGGAGATCCAAAC
TGCAAAATTGACTTGTCGTTTTTAATTGATGGGAGCACCAGCATTGGCAAACGGCGATTCCG
AATCCAGAAGCAGCTCCTGGCTGATGTTGCCCAAGCTCTTGACATTGGCCCTGCCGGTCCAC
TGATGGGTGTTGTCCAGTATGGAGACAACCCTGCTACTCACTTTAACCTCAAGACACACACG
AATTCTCGAGATCTGAAGACAGCCATAGAGAAAATTACTCAGAGAGGAGGACTTTCTAATGT
AGGTCGGGCCATCTCCTTTGTGACCAAGAACTTCTTTTCCAAAGCCAATGGAAACAGAAGCG
GGGCTCCCAATGTGGTGGTGGTGATGGTGGATGGCTGGCCCACGGACAAAGTGGAGGAGGCT
TCAAGACTTGCGAGAGAGTCAGGAATCAACATTTTCTTCATCACCATTGAAGGTGCTGCTGA
AAATGAGAAGCAGTATGTGGTGGAGCCCAACTTTGCAAACAAGGCCGTGTGCAGAACAAACG
GCTTCTACTCGCTCCACGTGCAGAGCTGGTTTGGCCTCCACAAGACCCTGCAGCCTCTGGTG
AAGCGGGTCTGCGACACTGACCGCCTGGCCTGCAGCAAGACCTGCTTGAACTCGGCTGACAT
TGGCTTCGTCATCGACGGCTCCAGCAGTGTGGGGACGGGCAACTTCCGCACCGTCCTCCAGT
TTGTGACCAACCTCACCAAAGAGTTTGAGATTTCCGACACGGACACGCGCATCGGGGCCGTG
CAGTACACCTACGAACAGCGGCTGGAGTTTGGGTTCGACAAGTACAGCAGCAAGCCTGACAT
CCTCAACGCCATCAAGAGGGTGGGCTACTGGAGTGGTGGCACCAGCACGGGGGCTGCCATCA
ACTTCGCCCTGGAGCAGCTCTTCAAGAAGTCCAAGCCCAACAAGAGGAAGTTAATGATCCTC
ATCACCGACGGGAGGTCCTACGACGACGTCCGGATCCCAGCCATGGCTGCCCATCTGAAGGG
AGTGATCACCTATGCGATAGGCGTTGCCTGGGCTGCCAAGAGGAGCTAGAAGTCATTGCCA
CTCACCCCGCCAGAGACCACTCCTTCTTTGTGGACGAGTTTGACAACCTCCATCAGTATGTC
CCCAGGATCATCCAGAACATTTGTACAGAGTTCAACTCACAGCCTCGGAACTGAATTCAGAG
CAGGCAGAGCACCAGCAAGTGCTGCTTTACTAACTGACGTGTTGGACCACCCCACCGCTTAA
TGGGGCACGCACGGTGCATCAAGTCTTGGGCAGGGCATGGAGAAACAAATGTCTTGTTATTA
TTCTTTGCCATCATGCTTTTTCATATTCCAAAACTTGGAGTTACAAAGATGATCACAAACGT
ATAGAATGAGCCAAAAGGCTACATCATGTTGAGGGTGCTGGAGATTTTACATTTTGACAATT
GTTTTCAAAATAAATGTTCGGAATACAGTGCAGCCCTTACGACAGGCTTACGTAGAGCTTTT
GTGAGATTTTTAAGTTGTTATTTCTGATTTGAACTCTGTAACCCTCAGCAAGTTTCATTTTT
GTCATGACAATGTAGGAATTGCTGAATTAAATGTTTAGAAGGATGAAAAATAAAAAAAAAAA
AAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAG
```

FIGURE 113

MRTVVLTMKASVIEMFLVLLVTGVHSNKETAKKIKRPKFTVPQINCDVKAGKIIDPEFIVKC
PAGCQDPKYHVYGTDVYASYSSVCGAAVHSGVLDNSGGKILVRKVAGQSGYKGSYSNGVQSL
SLPRWRESFIVLESKPKKGVTYPSALTYSSSKSPAAQAGETTKAYQRPPIPGTTAQPVTLMQ
LLAVTVAVATPTTLPRPSPSAASTTSIPRPQSVGHRSQEMDLWSTATYTSSQNRPRADPGIQ
RQDPSGAAFQKPVGADVSLGLVPKEELSTQSLEPVSLGDPNCKIDLSFLIDGSTSIGKRRFR
IQKQLLADVAQALDIGPAGPLMGVVQYGDNPATHFNLKTHTNSRDLKTAIEKITQRGGLSNV
GRAISFVTKNFFSKANGNRSGAPNVVVVMVDGWPTDKVEEASRLARESGINIFFITIEGAAE
NEKQYVVEPNFANKAVCRTNGFYSLHVQSWFGLHKTLQPLVKRVCDTDRLACSKTCLNSADI
GFVIDGSSSVGTGNFRTVLQFVTNLTKEFEISDTDTRIGAVQYTYEQRLEFGFDKYSSKPDI
LNAIKRVGYWSGGTSTGAAINFALEQLFKKSKPNKRKLMILITDGRSYDDVRIPAMAAHLKG
VITYAIGVAWAAQEELEVIATHPARDHSFFVDEFDNLHQYVPRIIQNICTEFNSQPRN

FIGURE 114

```
CAGGATGAACTGGTTGCAGTGGCTGCTGCTGCTGCGGGGGCGCTGAGAGGACACGAGCTCTA
TGCCTTTCCGGCTGCTCATCCCGCTCGGCCTCCTGTGCGCGCTGCTGCCTCAGCACCATGGT
GCGCCAGGTCCCGACGGCTCCGCGCCAGATCCCGCCCACTACAGTTTTTCTCTGACTCTAAT
TGATGCACTGGACACCTTGCTGATTTTGGGGAATGTCTCAGAATTCCAAAGAGTGGTTGAAG
TGCTCCAGGACAGCGTGGACTTTGATATTGATGTGAACGCCTCTGTGTTTGAAACAAACATT
CGAGTGGTAGGAGGACTCCTGTCTGCTCATCTGCTCTCCAAGAAGGCTGGGGTGGAAGTAGA
GGCTGGATGGCCCTGTTCCGGGCCTCTCCTGAGAATGGCTGAGGAGGCGGCCCGAAAACTCC
TCCCAGCCTTTCAGACCCCACTGGCATGCCATATGGAACAGTGAACTTACTTCATGGCGTG
AACCCAGGAGAGACCCCTGTCACCTGTACGGCAGGGATTGGGACCTTCATTGTTGAATTTGC
CACCCTGAGCAGCCTCACTGGTGACCCGGTGTTCGAAGATGTGGCCAGAGTGGCTTTGATGC
GCCTCTGGGAGAGCCGGTCAGATATCGGGCTGGTCGGCAACCACATTGATGTGCTCACTGGC
AAGTGGGTGGCCCAGGACGCAGGCATCGGGGCTGGCGTGGACTCCTACTTTGAGTACTTGGT
GAAAGGAGCCATCCTGCTTCAGGATAAGAAGCTCATGGCCATGTTCCTAGAGTATAACAAAG
CCATCCGGAACTACACCCGCTTCGATGACTGGTACCTGTGGGTTCAGATGTACAAGGGGACT
GTGTCCATGCCAGTCTTCCAGTCCTTGGAGGCCTACTGGCCTGGTCTTCAGAGCCTCATTGG
AGACATTGACAATGCCATGAGGACCTTCCTCAACTACTACACTGTATGGAAGCAGTTTGGGG
GGCTCCCGGAATTCTACAACATTCCTCAGGGATACACAGTGGAGAAGCGAGAGGGCTACCCA
CTTCGGCCAGAACTTATTGAAAGCGCAATGTACCTCTACCGTGCCACGGGGGATCCCACCCT
CCTAGAACTCGGAAGAGATGCTGTGGAATCCATTGAAAAAATCAGCAAGGTGGAGTGCGGAT
TTGCAACAATCAAAGATCTGCGAGACCACAAGCTGGACAACCGCATGGAGTCGTTCTTCCTG
GCCGAGACTGTGAAATACCTCTACCTCCTGTTTGACCCAACCAACTTCATCCACAACAATGG
GTCCACCTTCGACGCGGTGATCACCCCCTATGGGGAGTGCATCCTGGGGGCTGGGGGGTACA
TCTTCAACACAGAAGCTCACCCCATCGACCTTGCCGCCCTGCACTGCTGCCAGAGGCTGAAG
GAAGAGCAGTGGGAGGTGGAGGACTTGATGAGGGAATTCTACTCTCTCAAACGGAGCAGGTC
GAAATTTCAGAAAACACTGTTAGTTCGGGGCCATGGAACCTCCAGCAAGGCCAGGAACAC
TCTTCTCACCAGAAAACCATGACCAGGCAAGGGAGAGGAAGCCTGCCAAACAGAAGGTCCCA
CTTCTCAGCTGCCCCAGTCAGCCCTTCACCTCCAAGTTGGCATTACTGGGACAGGTTTTCCT
AGACTCCTCATAACCACTGGATAATTTTTTATTTTTATTTTTTTGAGGCTAAACTATAATA
AATTGCTTTTGGCTATCATAAAA
```

FIGURE 115

MPFRLLIPLGLLCALLPQHHGAPGPDGSAPDPAHYSFSLTLIDALDTLLILGNVSEFQRVVE
VLQDSVDFDIDVNASVFETNIRVVGGLLSAHLLSKKAGVEVEAGWPCSGPLLRMAEEAARKL
LPAFQTPTGMPYGTVNLLHGVNPGETPVTCTAGIGTFIVEFATLSSLTGDPVFEDVARVALM
RLWESRSDIGLVGNHIDVLTGKWVAQDAGIGAGVDSYFEYLVKGAILLQDKKLMAMFLEYNK
AIRNYTRFDDWYLWVQMYKGTVSMPVFQSLEAYWPGLQSLIGDIDNAMRTFLNYYTVWKQFG
GLPEFYNIPQGYTVEKREGYPLRPELIESAMYLYRATGDPTLLELGRDAVESIEKISKVECG
FATIKDLRDHKLDNRMESFFLAETVKYLYLLFDPTNFIHNNGSTFDAVITPYGECILGAGGY
IFNTEAHPIDLAALHCCQRLKEEQWEVEDLMREFYSLKRSRSKFQKNTVSSGPWEPPARPGT
LFSPENHDQARERKPAKQKVPLLSCPSQPFTSKLALLGQVFLDSS

FIGURE 116

AAAGTTACATTTTCTCTGGAACTCTCCTAGGCCACTCCCTGCTGATGCAACATCTGGGTTTG
GGCAGAAAGGAGGGTGCTTCGGAGCCCGCCCTTTCTGAGCTTCCTGGGCCGGCTCTAGAACA
ATTCAGGCTTCGCTGCGACTCAGACCTCAGCTCCAACATATGCATTCTGAAGAAAGATGGCT
GAGATGGACAGAATGCTTTATTTTGGAAAGAAACAATGTTCTAGGTCAAACTGAGTCTACCA
AATGCAGACTTTCACAATGGTTCTAGAAGAAATCTGGACAAGTCTTTTCATGTGGTTTTTCT
ACGCATTGATTCCATGTTTGCTCACAGATGAAGTGGCCATTCTGCCTGCCCCTCAGAACCTC
TCTGTACTCTCAACCAACATGAAGCATCTCTTGATGTGGAGCCCAGTGATCGCGCCTGGAGA
AACAGTGTACTATTCTGTCGAATACCAGGGGGAGTACGAGAGCCTGTACACGAGCCACATCT
GGATCCCCAGCAGCTGGTGCTCACTCACTGAAGGTCCTGAGTGTGATGTCACTGATGACATC
ACGGCCACTGTGCCATACAACCTTCGTGTCAGGGCCACATTGGGCTCACAGACCTCAGCCTG
GAGCATCCTGAAGCATCCCTTTAATAGAAACTCAACCATCCTTACCCGACCTGGGATGGAGA
TCACCAAAGATGGCTTCCACCTGGTTATTGAGCTGGAGGACCTGGGGCCCCAGTTTGAGTTC
CTTGTGGCCTACTGGAGGAGGGAGCCTGGTGCCGAGGAACATGTCAAAATGGTGAGGAGTGG
GGGTATTCCAGTGCACCTAGAAACCATGGAGCCAGGGGCTGCATACTGTGTGAAGGCCCAGA
CATTCGTGAAGGCCATTGGGAGGTACAGCGCCTTCAGCCAGACAGAATGTGTGGAGGTGCAA
GGAGAGGCCATTCCCCTGGTACTGGCCCTGTTTGCCTTTGTTGGCTTCATGCTGATCCTTGT
GGTCGTGCCACTGTTCGTCTGGAAAATGGGCCGGCTGCTCCAGTACTCCTGTTGCCCCGTGG
TGGTCCTCCCAGACACCTTGAAAATAACCAATTCACCCCAGAAGTTAATCAGCTGCAGAAGG
GAGGAGGTGGATGCCTGTGCCACGGCTGTGATGTCTCCTGAGGAACTCCTCAGGGCCTGGAT
CTCATAGGTTTGCGGAAGGGCCCAGGTGAAGCCGAGAACCTGGTCTGCATGACATGGAAACC
ATGAGGGGACAAGTTGTGTTTCTGTTTTCCGCCACGGACAAGGGATGAGAGAAGTAGGAAGA
GCCTGTTGTCTACAAGTCTAGAAGCAACCATCAGAGGCAGGGTGGTTTGTCTAACAGAACAC
TGACTGAGGCTTAGGGGATGTGACCTCTAGACTGGGGGCTGCCACTTGCTGGCTGAGCAACC
CTGGGAAAAGTGACTTCATCCCTTCGGTCCTAAGTTTTCTCATCTGTAATGGGGGAATTACC
TACACACCTGCTAAACACACACACAGAGTCTCTCTCTATATATACACACGTACACATAAA
TACACCCAGCACTTGCAAGGCTAGAGGGAAACTGGTGACACTCTACAGTCTGACTGATTCAG
TGTTTCTGGAGAGCAGGACATAAATGTATGATGAGAATGATCAAGGACTCTACACACTGGGT
GGCTTGGAGAGCCCACTTTCCCAGAATAATCCTTGAGAGAAAAGGAATCATGGGAGCAATGG
TGTTGAGTTCACTTCAAGCCCAATGCCGGTGCAGAGGGGAATGGCTTAGCGAGCTCTACAGT
AGGTGACCTGGAGGAAGGTCACAGCCACACTGAAAATGGGATGTGCATGAACACGGAGGATC
CATGAACTACTGTAAAGTGTTGACAGTGTGTGCACACTGCAGACAGCAGGTGAAATGTATGT
GTGCAATGCGACGAGAATGCAGAAGTCAGTAACATGTGCATGTTTGTTGTGCTCCTTTTTTC
TGTTGGTAAAGTACAGAATTCAGCAAATAAAAGGGCCACCCTGGCCAAAAGCGGTAAAAAA
AAAAAAAAAA

FIGURE 117

MQTFTMVLEEIWTSLFMWFFYALIPCLLTDEVAILPAPQNLSVLSTNMKHLLMWSPVIAPGE
TVYYSVEYQGEYESLYTSHIWIPSSWCSLTEGPECDVTDDITATVPYNLRVRATLGSQTSAW
SILKHPFNRNSTILTRPGMEITKDGFHLVIELEDLGPQFEFLVAYWRREPGAEEHVKMVRSG
GIPVHLETMEPGAAYCVKAQTFVKAIGRYSAFSQTECVEVQGEAIPLVLALFAFVGFMLILV
VVPLFVWKMGRLLQYSCCPVVVLPDTLKITNSPQKLISCRREEVDACATAVMSPEELLRAWIS

Important features:

Signal peptide:

amino acids 1-29

Transmembrane domain:

amino acids 230-255

N-glycosylation sites.

amino acids 40-43 and 134-137

Tissue factor proteins homology.

amino acids 92-119

Integrins alpha chain protein homology.

amino acids 232-262

FIGURE 118

```
TCCTGCTGATGCACATCTGGGTTTGGCAAAAGGAGGTTGCTTCGAGCCGCCCTTTCTAGCTT
CCTGGCCGGCTCTAGAACAATTCAGGCTTCGCTGCGACTAGACCTCAGCTCCAACATATGCA
TTCTGAAGAAAGATGGCTGAGATGACAGAATGCTTTATTTTGGAAAGAAACAATGTTCTAGG
TCAAACTGAGTCTACCAAATGCAGACTTTCACAATGGTTCTAGAAGAAATCTGGACAAGTCT
TTTCATGTGGTTTTTCTACGCATTGATTCCATGTTTGCTCACAGATGAAGTGGCCATTCTGC
CTGCCCCTCAGAACCTCTCTGTACTCTCAACCAACATGAAGCATCTCTTGATGTGGAGCCCA
GTGATCGCGCCTGGAGAAACAGTGTACTATTCTGTCGAATACCAGGGGGAGTACGAGAGCCT
GTACACGAGCCACATCTGGATCCCCAGCAGCTGGTGCTCACTCACTGAAGGTCCTGAGTGTG
ATGTCACTGATGACATCACGGCCACTGTGCCATACAACCTTTGTGTCAGGGCCACATTGGGC
TCACAGACCTCAGCCTGGAGCATCCTGAAGCATCCCTTTAATAGAAACTCAACCATCCTTAC
CCGACCTGGGATGGAGATCACCAAAGATGGCTTNCACCTGGTTATTGAGCTGGAGGACCTGG
GGCCCCAGTTTGAGTTCCTTGTGGCCTANTGGAGGAGGGGCGAACCCCTTGCGGCGCAAGGG
GTTNGCGAACCCCTTGCGGCCGCTGGGGTATCTCTCGAGAAAAGAGAGGCCCAATATGACCCAC
ATACTCAATATGGACGAANTGCTATTGTCCACCTGTTTGAGTGGCGCTGGGTTGAT
```

FIGURE 119

CGGACGCGTGGGCCGCCACCTCCGGAACAAGCCATGGTGGCGGCGACGGTGGCAGCGGCGTG
GCTGCTCCTGTGGGCTGCGGCCTGCGCGCAGCAGGAGCAGGACTTCTACGACTTCAAGGCGG
TCAACATCCGGGGCAAACTGGTGTCGCTGGAGAAGTACCGCGGATCGGTGTCCCTGGTGGTG
AATGTGGCCAGCGAGTGCGGCTTCACAGACCAGCACTACCGAGCCCTGCAGCAGCTGCAGCG
AGACCTGGGCCCCCACCACTTTAACGTGCTCGCCTTCCCCTGCAACCAGTTTGGCCAACAGG
AGCCTGACAGCAACAAGGAGATTGAGAGCTTTGCCCGCCGCACCTACAGTGTCTCATTCCCC
ATGTTTAGCAAGATTGCAGTCACCGGTACTGGTGCCCATCCTGCCTTCAAGTACCTGGCCCA
GACTTCTGGGAAGGAGCCCACCTGGAACTTCTGGAAGTACCTAGTAGCCCCAGATGGAAAGG
TGGTAGGGGCTTGGGACCCAACTGTGTCAGTGGAGGAGGTCAGACCCCAGATCACAGCGCTC
GTGAGGAAGCTCATCCTACTGAAGCGAGAAGACTTATAACCACCGCGTCTCCTCCTCCACCA
CCTCATCCCGCCCACCTGTGTGGGGCTGACCAATGCAAACTCAAATGGTGCTTCAAAGGGAG
AGACCCACTGACTCTCCTTCCTTTACTCTTATGCCATTGGTCCCATCATTCTTGTGGGGGAA
AAATTCTAGTATTTTGATTATTTGAATCTTACAGCAACAAATAGGAACTCCTGGCCAATGAG
AGCTCTTGACCAGTGAATCACCAGCCGATACGAACGTCTTGCCAACAAAAATGTGTGGCAAA
TAGAAGTATATCAAGCAATAATCTCCCACCCAAGGCTTCTGTAAACTGGGACCAATGATTAC
CTCATAGGGCTGTTGTGAGGATTAGGATGAAATACCTGTGAAAGTGCCTAGGCAGTGCCAGC
CAAATAGGAGGCATTCAATGAACATTTTTTGCATATAAACCAAAAAATAACTTGTTATCAAT
AAAAACTTGCATCCAACATGAATTTCCAGCCGATGATAATCCAGGCCAAAGGTTTAGTTGTT
GTTATTTCCTCTGTATTATTTTCTTCATTACAAAAGAAATGCAAGTTCATTGTAACAATCCA
AACAATACCTCACGATATAAAATAAAAATGAAAGTATCCTCCTCAAAAA

FIGURE 120

MVAATVAAAWLLLWAAACAQQEQDFYDFKAVNIRGKLVSLEKYRGSVSLVVNVASECGFTDQ
HYRALQQLQRDLGPHHFNVLAFPCNQFGQQEPDSNKEIESFARRTYSVSFPMFSKIAVTGTG
AHPAFKYLAQTSGKEPTWNFWKYLVAPDGKVVGAWDPTVSVEEVRPQITALVRKLILLKREDL

FIGURE 121

```
CGGACGCGTGGGCGGGCCGGGACGCAGGGCAAAGCGAGCCATGGCTGTCTACGTCGGGATGC
TGCGCCTGGGGAGGCTGTGCGCCGGGAGCTCGGGGGTGCTGGGGGCCCGGGCCGCCCTCTCT
CGGAGTTGGCAGGAAGCCAGGTTGCAGGGTGTCCGCTTCCTCAGTTCCAGAGAGGTGGATCG
CATGGTCTCCACGCCCATCGGAGGCCTCAGCTACGTTCAGGGGTGCACCAAAAAGCATCTTA
ACAGCAAGACTGTGGGCCAGTGCCTGGAGACCACAGCACAGAGGGTCCCAGAACGAGAGGCC
TTGGTCGTCCTCCATGAAGACGTCAGGTTGACCTTTGCCCAACTCAAGGAGGAGGTGGACAA
AGCTGCTTCTGGCCTCCTGAGCATTGGCCTCTGCAAAGGTGACCGGCTGGGCATGTGGGGAC
CTAACTCCTATGCATGGGTGCTCATGCAGTTGGCCACCGCCCAGGCGGGCATCATTCTGGTG
TCTGTGAACCCAGCCTACCAGGCTATGGAACTGGAGTATGTCCTCAAGAAGGTGGGCTGCAA
GGCCCTTGTGTTCCCCAAGCAATTCAAGACCCAGCAATACTACAACGTCCTGAAGCAGATCT
GTCCAGAAGTGGAGAATGCCCAGCCAGGGGCCTTGAAGAGTCAGAGGCTCCCAGATCTGACC
ACAGTCATCTCGGTGGATGCCCCTTTGCCGGGGACCCTGCTCCTGGATGAAGTGGTGGCGGC
TGGCAGCACACGGCAGCATCTGGACCAGCTCCAATACAACCAGCAGTTCCTGTCCTGCCATG
ACCCCATCAACATCCAGTTCACCTCGGGGACAACAGGCAGCCCCAAGGGGGCCACCCTCTCC
CACTACAACATTGTCAACAACTCCAACATTTTAGGAGAGCGCCTGAAACTGCATGAGAAGAC
ACCAGAGCAGTTGCGGATGATCCTGCCCAACCCCCTGTACCATTGCCTGGGTTCCGTGGCAG
GCACAATGATGTGTCTGATGTACGGTGCCACCCTCATCCTGGCCTCTCCCATCTTCAATGGC
AAGAAGGCACTGGAGGCCATCAGCAGAGAGAGAGGCACCTTCCTGTATGGTACCCCCACGAT
GTTCGTGGACATTCTGAACCAGCCAGACTTCTCCAGTTATGACATCTCGACCATGTGTGGAG
GTGTCATTGCTGGGTCCCCTGCACCTCCAGAGTTGATCCGAGCCATCATCAACAAGATAAAT
ATGAAGGACCTGGTGGTTGCTTATGGAACCACAGAGAACAGTCCCGTGACATTCGCGCACTT
CCCTGAGGACACTGTGGAGCAGAAGGCAGAAAGCGTGGGCAGAATTATGCCTCACACGGAGG
CCCGGATCATGAACATGGAGGCAGGGACGCTGGCAAAGCTGAACACGCCCGGGGAGCTGTGC
ATCCGAGGGTACTGCGTCATGCTGGGCTACTGGGGTGAGCCTCAGAAGACAGAGGAAGCAGT
GGATCAGGACAAGTGGTATTGGACAGGAGATGTCGCCACAATGAATGAGCAGGGCTTCTGCA
AGATCGTGGGCCGCTCTAAGGATATGATCATCCGGGGTGGTGAGAACATCTACCCCGCAGAG
CTCGAGGACTTCTTTCACACACACCCGAAGGTGCAGGAAGTGCAGGTGGTGGGAGTGAAGGA
CGATCGGATGGGGGAAGAGATTTGTGCCTGCATTCGGCTGAAGGACGGGGAGGAGACCACGG
TGGAGGAGATAAAAGCTTTCTGCAAAGGGAAGATCTCTCACTTCAAGATTCCGAAGTACATC
GTGTTTGTCACAAACTACCCCCTCACCATTTCAGGAAAGATCCAGAAATTCAAACTTCGAGA
GCAGATGGAACGACATCTAAATCTGTGAATAAAGCAGCAGGCCTGTCCTGGCCGGTTGGCTT
GACTCTCTCCTGTCAGAATGCAACCTGGCTTTATGCACCTAGATGTCCCCAGCACCCAGTTC
TGAGCCAGGCACATCAAATGTCAAGGAATTGACTGAACGAACTAAGAGCTCCTGGATGGGTC
CGGGAACTCGCCTGGGCACAAGGTGCCAAAAGGCAGGCAGCCTGCCCAGGCCCTCCCTCCTG
TCCATCCCCCACATTCCCCTGTCTGTCCTTGTGATTTGGCATAAAGAGCTTCTGTTTTCTTT
GAAAAAAAAAAAAAAA
```

FIGURE 122

MAVYVGMLRLGRLCAGSSGVLGARAALSRSWQEARLQGVRFLSSREVDRMVSTPIGGLSYVQ
GCTKKHLNSKTVGQCLETTAQRVPEREALVVLHEDVRLTFAQLKEEVDKAASGLLSIGLCKG
DRLGMWGPNSYAWVLMQLATAQAGIILVSVNPAYQAMELEYVLKKVGCKALVFPKQFKTQQY
YNVLKQICPEVENAQPGALKSQRLPDLTTVISVDAPLPGTLLLDEVVAAGSTRQHLDQLQYN
QQFLSCHDPINIQFTSGTTGSPKGATLSHYNIVNNSNILGERLKLHEKTPEQLRMILPNPLY
HCLGSVAGTMMCLMYGATLILASPIFNGKKALEAISRERGTFLYGTPTMFVDILNQPDFSSY
DISTMCGGVIAGSPAPPELIRAIINKINMKDLVVAYGTTENSPVTFAHFPEDTVEQKAESVG
RIMPHTEARIMNMEAGTLAKLNTPGELCIRGYCVMLGYWGEPQKTEEAVDQDKWYWTGDVAT
MNEQGFCKIVGRSKDMIIRGGENIYPAELEDFFHTHPKVQEVQVVGVKDDRMGEEICACIRL
KDGEETTVEEIKAFCKGKISHFKIPKYIVFVTNYPLTISGKIQKFKLREQMERHLNL

Signal Peptide:

amino acids 1-22

Transmembrane Domains:

amino acids 140-161, 213-229, 312-334

Putative AMP-binding Domain Signature:

amino acids 260-271

N-myristoylation Sites:

amino acids 19-24, 22-27, 120-125, 203-208, 268-273, 272-277, 314-319, 318-323, 379-384, 380-385, 409-413

N-glycosylation Site:

amino acids 282-285

FIGURE 123

CAACTCCAACATTTTAGGAGAGCGCCTGAAACTGCATGAGAAGACACCAGAGCAGTTGCGGA
TGATCCTGCCCAACCCCCTGTACCATTGCCTGGGTTCCGTGGCAGGCACAATGATGTGTCTG
ATGTACGGTGCCACCCTCATCCTGGCCTCTCCCATCTTCAATGGCAAGAAGGCACTGGAGGC
CATCAGCAGAGAGAGAGGCACCTTCCTGTATGGTACCCCACGATGTTCGTGGACATTCTGA
ACCAGCCAGACTTCTCCAGTTATGACATCTCGACCATGTGTGGAGGTGTCATTGCTGGGTCC
CCTGCACCTCCAGAGTTGATCCGAGCCATCATCAACAAGATAAATATCAAGGACCTGGTGGT
TGCTTATGGAACCACAGAGAACAGTCCCGTGACATTCGCGCACTTCCCTGAGGACACTGTGG
AGCAGAAGGCAGAAAGCGTGGGCAGAATTATGCCTCACACGGAGGCGCGGATCATGAACATG
GAGGCAGGGACGCTGGCAAAGCTGAACACGCCCGGGGAGCTGTGCATCCGAGGGTACTGCGT
CATGCTGGGCTACTGGGGTGAGCCTCAGAAGACAGAGGAAGCAGTGGATCAGGACAAGTGGT
ATTGGACAGGAGATGTCGCCAC

FIGURE 124

```
GAGCAGGACGGAGCCATGGACCCCGCCAGGAAAGCAGGTGCCCAGGCCATGATCTGGACTGC
AGGCTGGCTGCTGCTGCTGCTGCTTCGCGGAGGAGCGCAGGCCCTGGAGTGCTACAGCTGCG
TGCAGAAAGCAGATGACGGATGCTCCCCGAACAAGATGAAGACAGTGAAGTGCGCGCCGGGC
GTGGACGTCTGCACCGAGGCCGTGGGGGCGGTGGAGACCATCCACGGACAATTCTCGCTGGC
AGTGCGGGGTTGCGGTTCGGGACTCCCCGGCAAGAATGACCGCGGCCTGGATCTTCACGGGC
TTCTGGCGTTCATCCAGCTGCAGCAATGCGCTCAGGATCGCTGCAACGCCAAGCTCAACCTC
ACCTCGCGGGCGCTCGACCCGGCAGGTAATGAGAGTGCATACCCGCCCAACGGCGTGGAGTG
CTACAGCTGTGTGGGCCTGAGCCGGGAGGCGTGCCAGGGTACATCGCCGCCGGTCGTGAGCT
GCTACAACGCCAGCGATCATGTCTACAAGGGCTGCTTCGACGGCAACGTCACCTTGACGGCA
GCTAATGTGACTGTGTCCTTGCCTGTCCGGGCTGTGTCCAGGATGAATTCTGCACTCGGGA
TGGAGTAACAGGCCCAGGGTTCACGCTCAGTGGCTCCTGTTGCCAGGGGTCCCGCTGTAACT
CTGACCTCCGCAACAAGACCTACTTCTCCCCTCGAATCCCACCCCTTGTCCGGCTGCCCCCT
CCAGAGCCCACGACTGTGGCCTCAACCACATCTGTCACCACTTCTACCTCGGCCCCAGTGAG
ACCCACATCCACCACCAAACCCATGCCAGCGCCAACCAGTCAGACTCCGAGACAGGGAGTAG
AACACGAGGCCTCCCGGGATGAGGAGCCCAGGTTGACTGGAGGCGCCGCTGGCCACCAGGAC
CGCAGCAATTCAGGGCAGTATCCTGCAAAAGGGGGCCCCAGCAGCCCCATAATAAAGGCTG
TGTGGCTCCCACAGCTGGATTGGCAGCCCTTCTGTTGGCCGTGGCTGCTGGTGTCCTACTGT
GAGCTTCTCCACCTGGAAATTTCCCTCTCACCTACTTCTCTGGCCCTGGGTACCCCTCTTCT
CATCACTTCCTGTTCCCACCACTGGACTGGGCTGGCCCAGCCCCTGTTTTTCCAACATTCCC
CAGTATCCCCAGCTTCTGCTGCGCTGGTTTGCGGCTTTGGGAAATAAAATACCGTTGTATAT
ATTCTGCCAGGGGTGTTCTAGCTTTTTGAGGACAGCTCCTGTATCCTTCTCATCCTTGTCTC
TCCGCTTGTCCTCTTGTGATGTTAGGACAGAGTGAGAGAAGTCAGCTGTCACGGGGAAGGTG
AGAGAGAGGATGCTAAGCTTCCTACTCACTTTCTCCTAGCCAGCCTGGACTTTGGAGCGTGG
GGTGGGTGGGACAATGGCTCCCCACTCTAAGCACTGCCTCCCCTACTCCCCGCATCTTTGGG
GAATCGGTTCCCCATATGTCTTCCTTACTAGACTGTGAGCTCCTCGAGGGGGGGCCCGGTAC
CCAATTCGCCCTATAGTGAGTCGTA
```

FIGURE 125

MDPARKAGAQAMIWTAGWLLLLLLRGGAQALECYSCVQKADDGCSPNKMKTVKCAPGVDVCT
EAVGAVETIHGQFSLAVRGCGSGLPGKNDRGLDLHGLLAFIQLQQCAQDRCNAKLNLTSRAL
DPAGNESAYPPNGVECYSCVGLSREACQGTSPPVVSCYNASDHVYKGCFDGNVTLTAANVTV
SLPVRGCVQDEFCTRDGVTGPGFTLSGSCCQGSRCNSDLRNKTYFSPRIPPLVRLPPPEPTT
VASTTSVTTSTSAPVRPTSTTKPMPAPTSQTPRQGVEHEASRDEEPRLTGGAAGHQDRSNSG
QYPAKGGPQQPHNKGCVAPTAGLAALLLAVAAGVLL

FIGURE 126

CGGGACTCGGCGGGTCCTCCTGGGAGTCTCGGAGGGGACCGGCTGTGCAGACGCCATGGAGT
TGGTGCTGGTCTTCCTCTGCAGCCTGCTGGCCCCCATGGTCCTGGCCAGTGCAGCTGAAAAG
GAGAAGGAAATGGACCCTTTTCATTATGATTACCAGACCCTGAGGATTGGGGGACTGGTGTT
CGCTGTGGTCCTCTTCTCGGTTGGGATCCTCCTTATCCTAAGTCGCAGGTGCAAGTGCAGTT
TCAATCAGAAGCCCCGGCCCCAGGAGATGAGGAAGCCCAGGTGGAGAACCTCATCACCGCC
AATGCAACAGAGCCCCAGAAGCAGAGAACTGAAGTGCAGCCATCAGGTGGAAGCCTCTGGAA
CCTGAGGCGGCTGCTTGAACCTTTGGATGCAAATGTCGATGCTTAAGAAAACCGGCCACTTC
AGCAACAGCCCTTTCCCCAGGAGAAGCCAAGAACTTGTGTGTCCCCACCCTATCCCCTCTA
ACACCATTCCTCCACCTGATGATGCAACTAACACTTGCCTCCCCACTGCAGCCTGCGGTCCT
GCCCACCTCCCGTGATGTGTGTGTGTGTGTGTGTGTGACTGTGTGTGTTTGCTAACTGTG
GTCTTTGTGGCTACTTGTTTGTGGATGGTATTGTGTTTGTTAGTGAACTGTGGACTCGCTTT
CCCAGGCAGGGCTGAGCCACATGGCCATCTGCTCCTCCCTGCCCCGTGGCCCTCCATCAC
CTTCTGCTCCTAGGAGGCTGCTTGTTGCCCGAGACCAGCCCCTCCCCTGATTTAGGGATGC
GTAGGGTAAGAGCACGGGCAGTGGTCTTCAGTCGTCTTGGGACCTGGGAAGGTTTGCAGCAC
TTTGTCATCATTCTTCATGGACTCCTTTCACTCCTTTAACAAAAACCTTGCTTCCTTATCCC
ACCTGATCCCAGTCTGAAGGTCTCTTAGCAACTGGAGATACAAAGCAAGGAGCTGGTGAGCC
CAGCGTTGACGTCAGGCAGGCTATGCCCTTCCGTGGTTAATTTCTTCCCAGGGGCTTCCACG
AGGAGTCCCCATCTGCCCCGCCCCTTCACAGAGCGCCGGGGATTCCAGGCCCAGGGCTTCT
ACTCTGCCCCTGGGGAATGTGTCCCCTGCATATCTTCTCAGCAATAACTCCATGGGCTCTGG
GACCCTACCCCTTCCAACCTTCCCTGCTTCTGAGACTTCAATCTACAGCCCAGCTCATCCAG
ATGCAGACTACAGTCCCTGCAATTGGGTCTCTGGCAGGCAATAGTTGAAGGACTCCTGTTCC
GTTGGGGCCAGCACACCGGGATGGATGGAGGGAGAGCAGAGGCCTTTGCTTCTCTGCCTACG
TCCCCTTAGATGGGCAGCAGAGGCAACTCCCGCATCCTTTGCTCTGCCTGTCGGTGGTCAGA
GCGGTGAGCGAGGTGGGTTGGAGACTCAGCAGGCTCCGTGCAGCCCTTGGGAACAGTGAGAG
GTTGAAGGTCATAACGAGAGTGGGAACTCAACCCAGATCCCGCCCTCCTGTCCTCTGTGTT
CCCGCGGAAACCAACCAAACCGTGCGCTGTGACCCATTGCTGTTCTCTGTATCGTGATCTAT
CCTCAACAACAACAGAAAAAGGAATAAAATATCCTTTGTTTCCT

FIGURE 127

MELVLVFLCSLLAPMVLASAAEKEKEMDPFHYDYQTLRIGGLVFAVVLFSVGILLILSRRCK
CSFNQKPRAPGDEEAQVENLITANATEPQKQRTEVQPSGGSLWNLRRLLEPLDANVDA

FIGURE 128

AAACTTGACGCCATGAAGATCCCGGTCCTTCCTGCCGTGGTGCTCCTCTCCCTCCTGGTGCT
CCACTCTGCCCAGGGAGCCACCCTGGGTGGTCCTGAGGAAGAAAGCACCATTGAGAATTATG
CGTCACGACCCGAGGCCTTTAACACCCCGTTCCTGAACATCGACAAATTGCGATCTGCGTTT
AAGGCTGATGAGTTCCTGAACTGGCACGCCCTCTTTGAGTCTATCAAAAGGAAACTTCCTTT
CCTCAACTGGGATGCCTTTCCTAAGCTGAAAGGACTGAGGAGCGCAACTCCTGATGCCCAGT
GACCATGACCTCCACTGGAAGAGGGGGCTAGCGTGAGCGCTGATTCTCAACCTACCATAACT
CTTTCCTGCCTCAGGAACTCCAATAAAACATTTTCCATCCAAA

FIGURE 129

MKIPVLPAVVLLSLLVLHSAQGATLGGPEEESTIENYASRPEAFNTPFLNIDKLRSAFKADE
FLNWHALFESIKRKLPFLNWDAFPKLKGLRSATPDAQ

FIGURE 130

CAGTTCTGAAATCAATGGAGTTAATTTAGGGAATACAAACCAGCCATGGGGGTGGAGATTGC
CTTTGCCTCAGTGATTCTCACCTGCCTCTCCCTTCTGGCAGCAGGAGTCTCCCAGGTTGTTC
TTCTCCAGCCAGTTCCAACTCAGGAGACAGGTCCCAAGGCCATGGGAGATCTCTCCTGTGGC
TTTGCCGGCCACTCATGAGAGTGTTTTTGTGTAAAGTATTTTTTAGAATACTGTTGACTTCT
TCATGATTTAATAACCATCCTTTGCGAAGTTTTATGAGGCTTTAGGGGAATGTCAACCCTCA
AATTTTTGTTATACTAGATGGCTTCCATTTACCCACCACTATTTTAAGGTCCCTTTATTTTT
AGGTTCAAGGTTCATTTGACTTGAGAAAGTGCCCTTCTGCAGCTTCATTGATTTGTTTATC
TTCACTATTAATTGTAACGATTAAAAAGAATAAGAGCACGCAGACCTCTAGGAGAATATTT
TATCCCTGGGTGCCCCTGACACATTTATGTAGTGATCCCACAAATGTGATTGTTAATTTAAA
TGTTATTCTAATATTAGTACATTCAGTTGTGATGTAATATGAATAACCAGAATCTATTTCTT
AAAAGTTTTGAGTATATTTTTCAACTAGATATTTGTATAGAAAGACTGAATAGTGATG

FIGURE 131

MGVEIAFASVILTCLSLLAAGVSQVVLLQPVPTQETGPKAMGDLSCGFAGHS

FIGURE 132

```
GGGGAATCTGCAGTAGGTCTGCCGGCGATGGAGTGGTGGGCTAGCTCGCCGCTTCGGCTCTG
GCTGCTGTTGTTCCTCCTGCCCTCAGCGCAGGGCCGCCAGAAGGAGTCAGGTTCAAAATGGA
AAGTATTTATTGACCAAATTAACAGGTCTTTGGAGAATTACGAACCATGTTCAAGTCAAAAC
TGCAGCTGCTACCATGGTGTCATAGAAGAGGATCTAACTCCTTTCCGAGGAGGCATCTCCAG
GAAGATGATGGCAGAGGTAGTCAGACGGAAGCTAGGGACCCACTATCAGATCACTAAGAACA
GACTGTACCGGGAAAATGACTGCATGTTCCCCTCAAGGTGTAGTGGTGTTGAGCACTTTATT
TTGGAAGTGATCGGGCGTCTCCCTGACATGGAGATGGTGATCAATGTACGAGATTATCCTCA
GGTTCCTAAATGGATGGAGCCTGCCATCCCAGTCTTCTCCTTCAGTAAGACATCAGAGTACC
ATGATATCATGTATCCTGCTTGGACATTTTGGGAAGGGGACCTGCTGTTTGGCCAATTTAT
CCTACAGGTCTTGGACGGTGGGACCTCTTCAGAGAAGATCTGGTAAGGTCAGCAGCACAGTG
GCCATGGAAAAGAAAAACTCTACAGCATATTTCCGAGGATCAAGGACAAGTCCAGAACGAG
ATCCTCTCATTCTTCTGTCTCGGAAAAACCCAAAACTTGTTGATGCAGAATACACCAAAAAC
CAGGCCTGGAAATCTATGAAAGATACCTTAGGAAAGCCAGCTGCTAAGGATGTCCATCTTGT
GGATCACTGCAAATACAAGTATCTGTTTAATTTTCGAGGCGTAGCTGCAAGTTTCCGGTTTA
AACACCTCTTCCTGTGTGGCTCACTTGTTTTCCATGTTGGTGATGAGTGGCTAGAATTCTTC
TATCCACAGCTGAAGCCATGGGTTCACTATATCCCAGTCAAAACAGATCTCTCCAATGTCCA
AGAGCTGTTACAATTTGTAAAAGCAAATGATGATGTAGCTCAAGAGATTGCTGAAAGGGGAA
GCCAGTTTATTAGGAACCATTTGCAGATGGATGACATCACCTGTTACTGGGAGAACCTCTTG
AGTGAATACTCTAAATTCCTGTCTTATAATGTAACGAGAAGGAAAGGTTATGATCAAATTAT
TCCCAAAATGTTGAAAACTGAACTATAGTAGTCATCATAGGACCATAGTCCTCTTTGTGGCA
ACAGATCTCAGATATCCTACGGTGAGAAGCTTACCATAAGCTTGGCTCCTATACCTTGAATA
TCTGCTATCAAGCCAAATACCTGGTTTTCCTTATCATGCTGCACCCAGAGCAACTCTTGAGA
AAGATTTAAAATGTGTCTAATACACTGATATGAAGCAGTTCAACTTTTTGGATGAATAAGGA
CCAGAAATCGTGAGATGTGGATTTTGAACCCAACTCTACCTTTCATTTTCTTAAGACCAATC
ACAGCTTGTGCCTCAGATCATCCACCTGTGTGAGTCCATCACTGTGAAATTGACTGTGTCCA
TGTGATGATGCCCTTTGTCCCATTATTTGGAGCAGAAAATTCGTCATTTGGAAGTAGTACAA
CTCATTGCTGGAATTGTGAAATTATTCAAGGCGTGATCTCTGTCACTTTATTTTAATGTAGG
AAACCCTATGGGGTTTATGAAAAATACTTGGGGATCATTCTCTGAATGGTCTAAGGAAGCGG
TAGCCATGCCATGCAATGATGTAGGAGTTCTCTTTTGTAAAACCATAAACTCTGTTACTCAG
GAGGTTTCTATAATGCCACATAGAAAGAGGCCAATTGCATGAGTAATTATTGCAATTGGATT
TCAGGTTCCCTTTTTGTGCCTTCATGCCCTACTTCTTAATGCCTCTCTAAAGCCAAA
```

FIGURE 133

MEWWASSPLRLWLLLFLLPSAQGRQKESGSKWKVFIDQINRSLENYEPCSSQNCSCYHGVIE
EDLTPFRGGISRKMMAEVVRRKLGTHYQITKNRLYRENDCMFPSRCSGVEHFILEVIGRLPD
MEMVINVRDYPQVPKWMEPAIPVFSFSKTSEYHDIMYPAWTFWEGGPAVWPIYPTGLGRWDL
FREDLVRSAAQWPWKKKNSTAYFRGSRTSPERDPLILLSRKNPKLVDAEYTKNQAWKSMKDT
LGKPAAKDVHLVDHCKYKYLFNFRGVAASFRFKHLFLCGSLVFHVGDEWLEFFYPQLKPWVH
YIPVKTDLSNVQELLQFVKANDDVAQEIAERGSQFIRNHLQMDDITCYWENLLSEYSKFLSY
NVTRRKGYDQIIPKMLKTEL

FIGURE 134

CACCCCTCCATTTCTCGCCATGGCCCCTGCACTGCTCCTGATCCCTGCTGCCCTCGCCTCTT
TCATCCTGGCCTTTGGCACCGGAGTGGAGTTCGTGCGCTTTACCTCCCTTCGGCCACTTCTT
GGAGGGATCCCGGAGTCTGGTGGTCCGGATGCCCGCCAGGGATGGCTGGCTGCCCTGCAGGA
CCGCAGCATCCTTGCCCCCCTGGCATGGGATCTGGGGCTCCTGCTTCTATTTGTTGGGCAGC
ACAGCCTCATGGCAGCTGAAAGAGTGAAGGCATGGACATCCCGGTACTTTGGGGTCCTTCAG
AGGTCACTGTATGTGGCCTGCACTGCCCTGGCCTTGCAGCTGGTGATGCGGTACTGGGAGCC
CATACCCAAAGGCCCTGTGTTGTGGGAGGCTCGGGCTGAGCCATGGGCCACCTGGGTGCCGC
TCCTCTGCTTTGTGCTCCATGTCATCTCCTGGCTCCTCATCTTTAGCATCCTTCTCGTCTTT
GACTATGCTGAGCTCATGGGCCTCAAACAGGTATACTACCATGTGCTGGGGCTGGGCGAGCC
TCTGGCCCTGAAGTCTCCCCGGGCTCTCAGACTCTTCTCCCACCTGCGCCACCCAGTGTGTG
TGGAGCTGCTGACAGTGCTGTGGGTGGTGCCTACCCTGGGCACGGACCGTCTCCTCCTTGCT
TTCCTCCTTACCCTCTACCTGGGCCTGGCTCACGGGCTTGATCAGCAAGACCTCCGCTACCT
CCGGGCCCAGCTACAAGAAAACTCCACCTGCTCTCTCGGCCCCAGGATGGGGAGGCAGAGT
GAGGAGCTCACTCTGGTTACAAGCCCTGTTCTTCCTCTCCCACTGAATTCTAAATCCTTAAC
ATCCAGGCCCTGGCTGCTTCATGCCAGAGGCCCAAATCCATGGACTGAAGGAGATGCCCCTT
CTACTACTTGAGACTTTATTCTCTGGGTCCAGCTCCATACCCTAAATTCTGAGTTTCAGCCA
CTGAACTCCAAGGTCCACTTCTCACCAGCAAGGAAGAGTGGGGTATGGAAGTCATCTGTCCC
TTCACTGTTTAGAGCATGACACTCTCCCCCTCAACAGCCTCCTGAGAAGGAAAGGATCTGCC
CTGACCACTCCCCTGGCACTGTTACTTGCCTCTGCGCCTCAGGGGTCCCCTTCTGCACCGCT
GGCTTCCACTCCAAGAAGGTGGACCAGGGTCTGCAAGTTCAACGGTCATAGCTGTCCCTCCA
GGCCCCAACCTTGCCTCACCACTCCCGGCCCTAGTCTCTGCACCTCCTTAGGCCCTGCCTCT
GGGCTCAGACCCCAACCTAGTCAAGGGGATTCTCCTGCTCTTAACTCGATGACTTGGGGCTC
CCTGCTCTCCCGAGGAAGATGCTCTGCAGGAAAATAAAGTCAGCCTTTTCTAAAAAAA

FIGURE 135

MAPALLLIPAALASFILAFGTGVEFVRFTSLRPLLGGIPESGGPDARQGWLAALQDRSILAP
LAWDLGLLLLFVGQHSLMAAERVKAWTSRYFGVLQRSLYVACTALALQLVMRYWEPIPKGPV
LWEARAEPWATWVPLLCFVLHVISWLLIFSILLVFDYAELMGLKQVYYHVLGLGEPLALKSP
RALRLFSHLRHPVCVELLTVLWVVPTLGTDRLLLAFLLTLYLGLAHGLDQQDLRYLRAQLQR
KLHLLSRPQDGEAE

Signal sequence:

amino acids 1-13

Transmembrane domains:

amino acids 58-76, 99-113, 141-159, 203-222

N-myristoylation sites:

amino acids 37-43, 42-48, 229-235

FIGURE 136

```
CCGAGCACAGGAGATTGCCTGCGTTTAGGAGGTGGCTGCGTTGTGGGAAAAGCTATCAAGGA
AGAAATTGCCAAACCATGTCTTTTTTTCTGTTTTCAGAGTAGTTCACAACAGATCTGAGTGT
TTTAATTAAGCATGGAATACAGAAAACAACAAAAAACTTAAGCTTTAATTTCATCTGGAATT
CCACAGTTTTCTTAGCTCCCTGGACCCGGTTGACCTGTTGGCTCTTCCCGCTGGCTGCTCTA
TCACGTGGTGCTCTCCGACTACTCACCCCGAGTGTAAAGAACCTTCGGCTCGCGTGCTTCTG
AGCTGCTGTGGATGGCCTCGGCTCTCTGGACTGTCCTTCCGAGTAGGATGTCACTGAGATCC
CTCAAATGGAGCCTCCTGCTGCTGTCACTCCTGAGTTTCTTTGTGATGTGGTACCTCAGCCT
TCCCCACTACAATGTGATAGAACGCGTGAACTGGATGTACTTCTATGAGTATGAGCCGATTT
ACAGACAAGACTTTCACTTCACACTTCGAGAGCATTCAAACTGCTCTCATCAAAATCCATTT
CTGGTCATTCTGGTGACCTCCCACCCTTCAGATGTGAAAGCCAGGCAGGCCATTAGAGTTAC
TTGGGGTGAAAAAAGTCTTGGTGGGGATATGAGGTTCTTACATTTTTCTTATTAGGCCAAG
AGGCTGAAAAGGAAGACAAAATGTTGGCATTGTCCTTAGAGGATGAACACCTTCTTTATGGT
GACATAATCCGACAAGATTTTTTAGACACATATAATAACCTGACCTTGAAAACCATTATGGC
ATTCAGGTGGGTAACTGAGTTTTGCCCCAATGCCAAGTACGTAATGAAGACAGACACTGATG
TTTTCATCAATACTGGCAATTTAGTGAAGTATCTTTTAAACCTAAACCACTCAGAGAAGTTT
TTCACAGGTTATCCTCTAATTGATAATTATTCCTATAGAGGATTTTACCAAAAAACCCATAT
TTCTTACCAGGAGTATCCTTTCAAGGTGTTCCCTCCATACTGCAGTGGGTTGGGTTATATAA
TGTCCAGAGATTTGGTGCCAAGGATCTATGAAATGATGGGTCACGTAAAACCCATCAAGTTT
GAAGATGTTTATGTCGGGATCTGTTTGAATTTATTAAAAGTGAACATTCATATTCCAGAAGA
CACAAATCTTTTCTTTCTATATAGAATCCATTTGGATGTCTGTCAACTGAGACGTGTGATTG
CAGCCCATGGCTTTTCTTCCAAGGAGATCATCACTTTTTGGCAGGTCATGCTAAGGAACACC
ACATGCCATTATTAACTTCACATTCTACAAAAAGCCTAGAAGGACAGGATACCTTGTGGAAA
GTGTTAAATAAAGTAGGTACTGTGGAAAATTCATGGGGAGGTCAGTGTGCTGGCTTACACTG
AACTGAAACTCATGAAAAACCCAGACTGGAGACTGGAGGGTTACACTTGTGATTTATTAGTC
AGGCCCTTCAAAGATGATATGTGGAGGAATTAAATATAAAGGAATTGGAGGTTTTGCTAAA
GAAATTAATAGGACCAAACAATTTGGACATGTCATTCTGTAGACTAGAATTTCTTAAAAGGG
TGTTACTGAGTTATAAGCTCACTAGGCTGTAAAAACAAAACAATGTAGAGTTTTATTTATTG
AACAATGTAGTCACTTGAAGGTTTTGTGTATATCTTATGTGGATTACCAATTTAAAAATATA
TGTAGTTCTGTGTCAAAAAACTTCTTCACTGAAGTTATACTGAACAAAATTTTACCTGTTTT
TGGTCATTTATAAAGTACTTCAAGATGTTGCAGTATTTCACAGTTATTATTATTTAAAATTA
CTTCAACTTTGTGTTTTTAAATGTTTTGACGATTTCAATACAAGATAAAAAGGATAGTGAAT
CATTCTTTACATGCAAACATTTTCCAGTTACTTAACTGATCAGTTTATTATTGATACATCAC
TCCATTAATGTAAAGTCATAGGTCATTATTGCATATCAGTAATCTCTTGGACTTTGTTAAAT
ATTTTACTGTGGTAATATAGAGAAGAATTAAAGCAAGAAAATCTGAAAA
```

FIGURE 137

MASALWTVLPSRMSLRSLKWSLLLLSLLSFFVMWYLSLPHYNVIERVNWMYFYEYEPIYRQD
FHFTLREHSNCSHQNPFLVILVTSHPSDVKARQAIRVTWGEKKSWWGYEVLTFFLLGQEAEK
EDKMLALSLEDEHLLYGDIIRQDFLDTYNNLTLKTIMAFRWVTEFCPNAKYVMKTDTDVFIN
TGNLVKYLLNLNHSEKFFTGYPLIDNYSYRGFYQKTHISYQEYPFKVFPPYCSGLGYIMSRD
LVPRIYEMMGHVKPIKFEDVYVGICLNLLKVNIHIPEDTNLFFLYRIHLDVCQLRRVIAAHG
FSSKEIITFWQVMLRNTTCHY

FIGURE 138

CCTCTGTCCACTGCTTTCGTGAAGACAAGATGAAGTTCACAATTGTCTTTGCTGGACTTCTT
GGAGTCTTTCTAGCTCCTGCCCTAGCTAACTATAATATCAACGTCAATGATGACAACAACAA
TGCTGGAAGTGGGCAGCAGTCAGTGAGTGTCAACAATGAACACAATGTGGCCAATGTTGACA
ATAACAACGGATGGGACTCCTGGAATTCCATCTGGGATTATGGAAATGGCTTTGCTGCAACC
AGACTCTTTCAAAAGAAGACATGCATTGTGCACAAAATGAACAAGGAAGTCATGCCCTCCAT
TCAATCCCTTGATGCACTGGTCAAGGAAAAGAAGCTTCAGGGTAAGGGACCAGGAGGACCAC
CTCCCAAGGGCCTGATGTACTCAGTCAACCCAAACAAAGTCGATGACCTGAGCAAGTTCGGA
AAAAACATTGCAAACATGTGTCGTGGGATTCCAACATACATGGCTGAGGAGATGCAAGAGGC
AAGCCTGTTTTTTTACTCAGGAACGTGCTACACGACCAGTGTACTATGGATTGTGGACATTT
CCTTCTGTGGAGACACGGTGGAGAACTAAACAATTTTTAAAGCCACTATGGATTTAGTCAT
CTGAATATGCTGTGCAGAAAAAATATGGGCTCCAGTGGTTTTTACCATGTCATTCTGAAATT
TTTCTCTACTAGTTATGTTTGATTTCTTTAAGTTTCAATAAAATCATTTAGCATTGAAAAAAA

FIGURE 139

MKFTIVFAGLLGVFLAPALANYNINVNDDNNNAGSGQQSVSVNNEHNVANVDNNNGWDSWNS
IWDYGNGFAATRLFQKKTCIVHKMNKEVMPSIQSLDALVKEKKLQGKGPGGPPPKGLMYSVN
PNKVDDLSKFGKNIANMCRGIPTYMAEEMQEASLFFYSGTCYTTSVLWIVDISFCGDTVEN

Signal Peptide:

amino acids 1-20

N-myristoylation Sites:

amino acids 67-72, 118-123, 163-168

Flavodoxin protein homology:

amino acids 156-174

FIGURE 140

```
CATTTCTGAAACTAATCGTGTCAGAATTGACTTTGAAAAGCATTGCTTTTTACAGAAGTATA
TTAACTTTTTAGGAGTAATTTCTAGTTTGGATTGTAATATGAAATAATTTAAAAGGGCTTCG
CTCATATATAGGAAAATCGCATATGGTCCTAGTATTAAATTCTTATTGCTTACTGATTTTTT
TGAGTTAAGAGTTGTTATATGCTAGAATATGAGGATGTGAATATAAATAAGAGAAGAAAAAA
GAATAAAGTAGATTGAGTCTCCAATTTTATGTAAGCTTCAGAAGAACTGGTTTGTTTACATG
CAAGCTTATAGTTGAAATATTTTTCAGGAATTACATGAATGACAGTCTTCGAACCAATGTGT
TTGTTCGATTTCAACCAGAGACTATAGCATGTGCTTGCATCTACCTTGCAGCTAGAGCACTT
CAGATTCCGTTGCCAACTCGTCCCCATTGGTTTCTTCTTTTTGGTACTACAGAAGAGGAAAT
CCAGGAAATCTGCATAGAAACACTTAGGCTTTATACCAGAAAAAGCCAAACTATGAATTAC
TGGAAAAAGAAGTAGAAAAAAGAAAAGTAGCCTTACAAGAAGCCAAATTAAAAGCAAAGGGA
TTGAATCCGGATGGAACTCCAGCCCTTTCAACCCTGGGTGGATTTTCTCCAGCCTCCAAGCC
ATCATCACCAAGAGAAGTAAAAGCTGAAGAGAAATCACCAATCTCCATTAATGTGAAGACAG
TCAAAAAGAACCTGAGGATAGACAACAGGCTTCCAAAAGCCCTTACAATGGTGTAAGAAAA
GACAGCAAGAGAAGTAGAAATAGCAGAAGTGCAAGTCGATCGAGGTCAAGAACACGATCACG
TTCTAGATCACATACTCCAAGAAGACACTATAATAATAGGCGGAGTCGATCTGGAACATACA
GCTCGAGATCAAGAAGCAGGTCCCGCAGTCACAGTGAAAGCCCTCGAAGACATCATAATCAT
GGTTCTCCTCACCTTAAGGCCAAGCATACCAGAGATGATTTAAAAAGTTCAAACAGACATGG
TCATAAAAGGAAAAAATCTCGTTCTCGATCTCAGAGCAAGTCTCGGGATCACTCAGATGCAG
CCAAGAAACACAGGCATGAAAGGGGACATCATAGGGACAGGCGTGAACGATCTCGCTCCTTT
GAGAGGTCCCATAAAAGCAAGCACCATGGTGGCAGTCGCTCAGGACATGGCAGGCACAGGCG
CTGACTTTCTCTTCCTTTGAGCCTGCATCAGTTCTTGGTTTTGCCTATCTACAGTGTGATGT
ATGGACTCAATCAAAAACATTAAACGCAAACTGATTAGGATTTGATTTCTTGAAACCCTCTA
GGTCTCTAGAACACTGAGGACAGTTTCTTTTGAAAAGAACTATGTTAATTTTTTTGCACATT
AAAATGCCCTAGCAGTATCTAATTAAAAACCATGGTCAGGTTCAATTGTACTTTATTATAGT
TGTGTATTGTTTATTGCTATAAGAACTGGAGCGTGAATTCTGTAAAAATGTATCTTATTTTT
ATACAGATAAAATTGCAGACACTGTTCTATTTAAGTGGTTATTTGTTTAAATGATGGTGAAT
ACTTTCTTAACACTGGTTTGTCTGCATGTGTAAAGATTTTTACAAGGAAATAAAATACAAAT
CTTGTTTTTTCTAAAAAAAAAAAAAAAAAGT
```

FIGURE 141

MNDSLRTNVFVRFQPETIACACIYLAARALQIPLPTRPHWFLLFGTTEEEIQEICIETLRLY
TRKKPNYELLEKEVEKRKVALQEAKLKAKGLNPDGTPALSTLGGFSPASKPSSPREVKAEEK
SPISINVKTVKKEPEDRQQASKSPYNGVRKDSKRSRNSRSASRSRSRTRSRSRSHTPRRHYN
NRRSRSGTYSSRSRSRSRSHSESPRRHHNHGSPHLKAKHTRDDLKSSNRHGHKRKKSRSRSQ
SKSRDHSDAAKKHRHERGHHRDRRERSRSFERSHKSKHHGGSRSGHGRHRR

FIGURE 142

```
TGGGGATAAAGGAAAAATGGTCAGGTATTAATGGCTTAAAGATTATTGGAAGGGGTTTATCA
TTTTTTGAANNTATTCGGGTCANAATTGNCTTTGAAAAGCATTGCTTTTTACAGAAATATAT
TANCTTTTTAGAGTAATTTCTAGTTTGGATTGTAATATGAAATTATTTAAAAGGGCTTCGCT
CATATATAGGAAAATCGCATATGGTCCTAGTATTAAATTNTTATTGCTTACTGATTTTTTG
AGTTAAGAGTTGTTATATGNTAGAATATGAGGATGTGAATATAAATAAGAGAAGAAAAAAGA
ATAAAGTAGATTGAGTCTCCAATTTTATGTAAGCTTCAGAAGAACTGGTTTGTTTACATGCA
AGCTTATAGTTGAAATATTTTTCAGGAATTACATGAATGACAGTCTTCGAACCAATGTGTTT
GTTCGATTTCAACCAGAGANTATAGCATGTGCTTGCATCTACCTTGCAGNTAGAGCACTTCA
GATTCCGTTGCCAACTNGTCCCCATTGGTTTCTTCTTTTTGGTACTACAGAAGAGGAAATCC
AGGAAATNTGCATAGAAACACTTAGGCTTTATACCAGAAAAAGCCAAACTATGAATTACTG
GAAAAAGAAGTAGAAAAAGAAAAGTAGCCTTACAAGAAGCCNAATTAAAAGCAAAGGGATT
GAATCCGGATGGAACTCCAGCCCTTTCAACCCTGGGTGGATTTTCTCC
```

FIGURE 143

```
GGCACGAGGCCTCGTGCCAAGCTTGGCACGAGGGTGCACCGCGTTCTCGCACGCGTCATGGC
GGTCCTCGGAGTACAGCTGGTGGTGACCCTGCTCACTGCCACCCTCATGCACAGGCTGGCGC
CACACTGCTCCTTCGCGCGCTGGCTGCTCTGTAACGGCAGTTTGTTCCGATACAAGCACCCG
TCTGAGGAGGAGCTTCGGGCCCTGGCGGGGAAGCCGAGGCCCAGAGGCAGGAAAGAGCGGTG
GGCCAATGGCCTTAGTGAGGAGAAGCCACTGTCTGTGCCCCGAGATGCCCCGTTCCAGCTGG
AGACCTGCCCCCTCACGACCGTGGATGCCCTGGTCCTGCGCTTCTTCCTGGAGTACCAGTGG
TTTGTGGACTTTGCTGTGTACTCGGGCGGCGTGTACCTCTTCACAGAGGCCTACTACTACAT
GCTGGGACCAGCCAAGGAGACTAACATTGCTGTGTTCTGGTGCCTGCTCACGGTGACCTTCT
CCATCAAGATGTTCCTGACAGTGACACGGCTGTACTTCAGCGCCGAGGAGGGGGTGAGCGC
TCTGTCTGCCTCACCTTTGCCTTCCTCTTCCTGCTGCTGGCCATGCTGGTGCAAGTGGTGCG
GGAGGAGACCCTCGAGCTGGGCCTGGAGCCTGGTCTGGCCAGCATGACCCAGAACTTAGAGC
CACTTCTGAAGAAGCAGGGCTGGGACTGGGCGCTTCCTGTGGCCAAGCTGGCTATCCGCGTG
GGACTGGCAGTGGTGGGCTCTGTGCTGGGTGCCTTCCTCACCTTCCCAGGCCTGCGGCTGGC
CCAGACCCACCGGGACGCACTGACCATGTCGGAGGACAGACCCATGCTGCAGTTCCTCCTGC
ACACCAGCTTCCTGTCTCCCTGTTCATCCTGTGGCTCTGGACAAAGCCCATTGCACGGGAC
TTCCTGCACCAGCCGCCGTTTGGGGAGACGCGTTTCTCCCTGCTGTCCGATTCTGCCTTCGA
CTCTGGGCGCCTCTGGTTGCTGGTGGTGCTGTGCCTGCTGCGGCTGGCGGTGACCCGGCCCC
ACCTGCAGGCCTACCTGTGCCTGGCCAAGGCCCGGGTGGAGCAGCTGCGAAGGGAGGCTGGC
CGCATCGAAGCCCGTGAAATCCAGCAGAGGGTGGTCCGAGTCTACTGCTATGTGACCGTGGT
GAGCTTGCAGTACCTGACGCCGCTCATCCTCACCCTCAACTGCACACTTCTGCTCAAGACGC
TGGGAGGCTATTCCTGGGGCCTGGGCCCAGCTCCTCTACTATCCCCCGACCCATCCTCAGCC
AGCGCTGCCCCCATCGGCTCTGGGGAGGACGAAGTCCAGCAGACTGCAGCGCGGATTGCCGG
GGCCCTGGGTGGCCTGCTTACTCCCCTCTTCCTCCGTGGCGTCCTGGCCTACCTCATCTGGT
GGACGGCTGCCTGCCAGCTGCTCGCCAGCCTTTTCGGCCTCTACTTCCACCAGCACTTGGCA
GGCTCCTAGCTGCCTGCAGACCCTCCTGGGCCCTGAGGTCTGTTCCTGGGGCAGCGGGACA
CTAGCCTGCCCCCTCTGTTTGCGCCCCGTGTCCCCAGCTGCAAGGTGGGGCCGGACTCCCC
GGCGTTCCCTTCACCACAGTGCCTGACCCGCGGCCCCCTTGGACGCCGAGTTTCTGCCTCA
GAACTGTCTCTCCTGGGCCCAGCAGCATGAGGGTCCCGAGGCCATTGTCTCCGAAGCGTATG
TGCCAGGTTTGAGTGGCGAGGGTGATGCTGGCTGCTCTTCTGAACAAATAAAGGAGCATGCC
GATTTTTAA
```

FIGURE 144

```
MAVLGVQLVVTLLTATLMHRLAPHCSFARWLLCNGSLFRYKHPSEEELRALAGKPRPRGRKE
RWANGLSEEKPLSVPRDAPFQLETCPLTTVDALVLRFFLEYQWFVDFAVYSGGVYLFTEAYY
YMLGPAKETNIAVFWCLLTVTFSIKMFLTVTRLYFSAEEGGERSVCLTFAFLFLLLAMLVQV
VREETLELGLEPGLASMTQNLEPLLKKQGWDWALPVAKLAIRVGLAVVGSVLGAFLTFPGLR
LAQTHRDALTMSEDRPMLQFLLHTSFLSPLFILWLWTKPIARDFLHQPPFGETRFSLLSDSA
FDSGRLWLLVVLCLLRLAVTRPHLQAYLCLAKARVEQLRREAGRIEAREIQQRVVRVYCYVT
VVSLQYLTPLILTLNCTLLLKTLGGYSWGLGPAPLLSPDPSSASAAPIGSGEDEVQQTAARI
AGALGGLLTPLFLRGVLAYLIWWTAACQLLASLFGLYFHQHLAGS
```

FIGURE 145

CGTTNGCACGCGTCAATGGCGGTCCTCGGAGTACAGCTGGTGGTGACCCTGCTCACTGCCAC
CCTCATGCACAGGCTGGCGCCACACTGCTCCTTCGCGCGCTGGCTGCTCTGTAACGGCAGTT
TGTTCCGATACAAGCACCCGTNTTGAGGAGGAGCTTCGGGCCCTGGCGGGGAAGCCGAGGCC
CAGAGGCAGGAAAGAGCGGTGGGCCAATGGCCTTAGTGAGGAGAAGCCACTGTCTGTGCCCC
GAGATGCCCCGTTCCAGCTGGAGACCTGCCCCCTCACGACCGTGGATGCCCTGGTCCTGCGC
TTCTTCCTGGAGTACCAGTGGTTTGTGGACTTTGCTGTGTACTCGGGCGGCGTGTACCTCTT
CACAGAGGCCTACTACTACATGCTGGGACCAGCCAAGGAGACTAACATTGCTGTGTTCTGGT
GCCTGCTCACAGTGACCTTCTCCATCAAGATGTTCCTGACAGTGACACGGCTGTACTTCAGC
GCCGAGGAGGGGGTGAGCGCTCTGTCTGCCTCACCTTTGCCTTCCTCTTCCTGCTGCTGGC
CATGCTGGTGCAAGCG

FIGURE 146

```
GGTTCCTACATCCTCTCATCTGAGAATCAGAGAGCATAATCTTCTTACGGGCCCGTGATTTATTAACGTGGCTT
AATCTGAAGGTTCTCAGTCAAATTCTTTGTGATCTACTGATTGTGGGGGCATGGCAAGGTTTGCTTAAAGGAGC
TTGGCTGGTTTGGGCCCTTGTAGCTGACAGAAGGTGGCCAGGGAGAATGCAGCACACTGCTCGGAGAATGAAGG
CGCTTCTGTTGCTGGTCTTGCCTTGGCTCAGTCCTGCTAACTACATTGACAATGTGGGCAACCTGCACTTCCTG
TATTCAGAACTCTGTAAAGGTGCCTCCCACTACGGCCTGACCAAAGATAGGAAGAGGCGCTCACAAGATGGCTG
TCCAGACGGCTGTGCGAGCCTCACAGCCACGGCTCCCTCCCCAGAGGTTTCTGCAGCTGCCACCATCTCCTTAA
TGACAGACGAGCCTGGCCTAGACAACCCTGCCTACGTGTCCTCGGCAGAGGACGGGCAGCCAGCAATCAGCCCA
GTGGACTCTGGCCGGAGCAACCGAACTAGGGCACGGCCCTTTGAGAGATCCACTATTAGAAGCAGATCATTTAA
AAAAATAAATCGAGCTTTGAGTGTTCTTCGAAGGACAAAGAGCGGGAGTGCAGTTGCCAACCATGCCGACCAGG
GCAGGGAAAATTCTGAAAACACCACTGCCCCTGAAGTCTTTCCAAGGTTGTACCACCTGATTCCACATGGTGAA
ATTACCAGCATCAAGATCAATCGAGTAGATCCCAGTGAAAGCCTCTCTATTAGGCTGGTGGGAGGTAGCGAAAC
CCCACTGGTCCATATCATTATCCAACACATTTATCGTGATGGGTGATCGCCAGAGACGGCCGGCTACTGCCAG
GAGACATCATTCTAAAGGTCAACGGGATGGACATCAGCAATGTCCCTCACAACTACGCTGTGCGTCTCCTGCGG
CAGCCCTGCCAGGTGCTGTGGCTGACTGTGATGCGTGAACAGAAGTTCCGCAGCAGGAACAATGGACAGGCCCC
GGATGCCTACAGACCCCGAGATGACAGCTTTCATGTGATTCTCAACAAAAGTAGCCCCGAGGAGCAGCTTGGAA
TAAAACTGGTGCGCAAGGTGGATGAGCCTGGGGTTTTCATCTTCAATGTGCTGGATGGCGGTGTGGCATATCGA
CATGGTCAGCTTGAGGAGAATGACCGTGTGTTAGCCATCAATGGACATGATCTTCGATATGGCAGCCCAGAAAG
TGCGGCTCATCTGATTCAGGCCAGTGAAAGACGTGTTCACCTCGTCGTGTCCCGCCAGGTTCGGCAGCGGAGCC
CTGACATCTTTCAGGAAGCCGGCTGGAACAGCAATGGCAGCTGGTCCCCAGGGCCAGGGGAGAGGAGCAACACT
CCCAAGCCCCTCCATCCTACAATTACTTGTCATGAGAAGGTGGTAAATATCCAAAAAGACCCCGGTGAATCTCT
CGGCATGACCGTCGCAGGGGGAGCATCACATAGAGAATGGGATTTGCCTATCTATGTCATCAGTGTTGAGCCCG
GAGGAGTCATAAGCAGAGATGGAAGAATAAAAACAGGTGACATTTTGTTGAATGTGGATGGGGTCGAACTGACA
GAGGTCAGCCGGAGTGAGGCAGTGGCATTATTGAAAAGAACATCATCCTCGATAGTACTCAAAGCTTTGGAAGT
CAAAGAGTATGAGCCCCACGAAGACTGCAGCAGCCCAGCAGCCCTGGACTCCAACCACAACATGGCCCCACCCA
GTGACTGGTCCCCATCCTGGGTCATGTGGCTGGAATTACCACGGTGCTTGTATAACTGTAAAGATATTGTATTA
CGAAGAAACACAGCTGGAAGTCTGGGCTTCTGCATTGTAGGAGGTTATGAAGAATACAATGGAAACAAACCTTT
TTTCATCAAATCCATTGTTGAAGGAACACCAGCATACAATGATGGAAGAATTAGATGTGGTGATATTCTTCTTG
CTGTCAATGGTAGAAGTACATCAGGAATGATACATGCTTGCTTGGCAAGACTGCTGAAAGAACTTAAAGGAAGA
ATTACTCTAACTATTGTTTCTTGGCCTGGCACTTTTTTATAGAATCAATGATGGGTCAGAGGAAAACAGAAAAA
TCACAAATAGGCTAAGAAGTTGAAACACTATATTTATCTTGTCAGTTTTTATATTTAAAGAAAGAATACATTGT
AAAAATGTCAGGAAAAGTATGATCATCTAATGAAAGCCAGTTACACCTCAGAAAATATGATTCCAAAAAAATTA
AAACTACTAGTTTTTTTTCAGTGTGGAGGATTTCTCATTACTCTACAACATTGTTTATATTTTTCTATTCAAT
AAAAAGCCCTAAAACAACTAAAATGATTGATTTGTATACCCCACTGAATTCAAGCTGATTTAAATTTAAAATTT
GGTATATGCTGAAGTCTGCCAAGGGTACATTATGGCCATTTTTAATTTACAGCTAAAATATTTTTTAAAATGCA
TTGCTGAGAAACGTTGCTTTCATCAAACAAGAATAAATATTTTTCAGAAGTTAAA
```

FIGURE 147

MKALLLLVLPWLSPANYIDNVGNLHFLYSELCKGASHYGLTKDRKRRSQDGCPDGCASLTAT
APSPEVSAAATISLMTDEPGLDNPAYVSSAEDGQPAISPVDSGRSNRTRARPFERSTIRSRS
FKKINRALSVLRRTKSGSAVANHADQGRENSENTTAPEVFPRLYHLIPDGEITSIKINRVDP
SESLSIRLVGGSETPLVHIIQHIYRDGVIARDGRLLPGDIILKVNGMDISNVPHNYAVRLL
RQPCQVLWLTVMREQKFRSRNNGQAPDAYRPRDDSFHVILNKSSPEEQLGIKLVRKVDEPGV
FIFNVLDGGVAYRHGQLEENDRVLAINGHDLRYGSPESAAHLIQASERRVHLVVSRQVRQRS
PDIFQEAGWNSNGSWSPGPGERSNTPKPLHPTITCHEKVVNIQKDPGESLGMTVAGGASHRE
WDLPIYVISVEPGGVISRDGRIKTGDILLNVDGVELTEVSRSEAVALLKRTSSSIVLKALEV
KEYEPQEDCSSPAALDSNHNMAPPSDWSPSWVMWLELPRCLYNCKDIVLRRNTAGSLGFCIV
GGYEEYNGNKPFFIKSIVEGTPAYNDGRIRCGDILLAVNGRSTSGMIHACLARLLKELKGRI
TLTIVSWPGTFL

FIGURE 148

CCAAAGTGATCATTTGAAAAAGAGATATCCACATCTTCAAGCCCATATAAAGGATAGAAGCT
GCACAGGGCAGCTTTACTTACTCCAGCACCTTCCTCTCCCAGGCAAATGGTGCTGACCATCT
TTGGGATACAATCTCATGGATACGAGGTTTTTAACATCATCAGCCCAAGCAACAATGGTGGC
AATGTTCAGGAGACAGTGACAATTGATAATGAAAAAAATACCGCCATCGTTAACATCCATGC
AGGATCATGCTCTTCTACCACAATTTTTGACTATAAACATGGCTACATTGCATCCAGGGTGC
TCTCCCGAAGAGCCTGCTTTATCCTGAAGATGGACCATCAGAACATCCCTCCTCTGAACAAT
CTCCAATGGTACATCTATGAGAAACAGGCTCTGGACAACATGTTCTCCAACAAATACACCTG
GGTCAAGTACAACCCTCTGGAGTCTCTGATCAAAGACGTGGATTGGTTCCTGCTTGGGTCAC
CCATTGAGAAACTCTGCAAACATATCCCTTTGTATAAGGGGGAAGTGGTTGAAAACACACAT
AATGTCGGTGCTGGAGGCTGTGCAAAGGCTGGGCTCCTGGGCATCTTGGGAATTTCAATCTG
TGCAGACATTCATGTTTAGGATGATTAGCCCTCTTGTTTTATCTTTTCAAAGAAATACATCC
TTGGTTTACACTCAAAAGTCAAATTAAATTCTTTCCCAATGCCCCAACTAATTTTGAGATTC
AGTCAGAAAATATAAATGCTGTATTTATA

FIGURE 149

MKILVAFLVVLTIFGIQSHGYEVFNIISPSNNGGNVQETVTIDNEKNTAIVNIHAGSCSSTT
IFDYKHGYIASRVLSRRACFILKMDHQNIPPLNNLQWYIYEKQALDNMFSNKYTWVKYNPLE
SLIKDVDWFLLGSPIEKLCKHIPLYKGEVVENTHNVGAGGCAKAGLLGILGISICADIHV

FIGURE 150

GGCACGAGCCAGGAACTAGGAGGTTCTCACTGCCCGAGCAGAGGCCCTACACCCACCGAGGC
ATGGGGCTCCCTGGGCTGTTCTGCTTGGCCGTGCTGGCTGCCAGCAGCTTCTCCAAGGCACG
GGAGGAAGAAATTACCCCTGTGGTCTCCATTGCCTACAAAGTCCTGGAAGTTTTCCCCAAAG
GCCGCTGGGTGCTCATAACCTGCTGTGCACCCCAGCCACCACCGCCCATCACCTATTCCCTC
TGTGGAACCAAGAACATCAAGGTGGCCAAGAAGGTGGTGAAGACCCACGAGCCGGCCTCCTT
CAACCTCAACGTCACACTCAAGTCCAGTCCAGACCTGCTCACCTACTTCTGCCGGGCGTCCT
CCACCTCAGGTGCCCATGTGGACAGTGCCAGGCTACAGATGCACTGGGAGCTGTGGTCCAAG
CCAGTGTCTGAGCTGCGGGCCAACTTCACTCTGCAGGACAGAGGGGCAGGCCCCAGGGTGGA
GATGATCTGCCAGGCGTCCTCGGGCAGCCCACCTATCACCAACAGCCTGATCGGGAAGGATG
GGCAGGTCCACCTGCAGCAGAGACCATGCCACAGGCAGCCTGCCAACTTCTCCTTCCTGCCG
AGCCAGACATCGGACTGGTTCTGGTGCCAGGCTGCAAACAACGCCAATGTCCAGCACAGCGC
CCTCACAGTGGTGCCCCCAGGTGGTGACCAGAAGATGGAGGACTGGCAGGGTCCCCTGGAGA
GCCCCATCCTTGCCTTGCCGCTCTACAGGAGCACCCGCCGTCTGAGTGAAGAGGAGTTTGGG
GGGTTCAGGATAGGGAATGGGGAGGTCAGAGGACGCAAAGCAGCAGCCATGTAGAATGAACC
GTCCAGAGAGCCAAGCACGGCAGAGGACTGCAGGCCATCAGCGTGCACTGTTCGTATTTGGA
GTTCATGCAAAATGAGTGTGTTTTAGCTGCTCTTGCCACAAAAAAAAAAAAAAAAAAAAAAA

FIGURE 151

MGLPGLFCLAVLAASSFSKAREEEITPVVSIAYKVLEVFPKGRWVLITCCAPQPPPPITYSL
CGTKNIKVAKKVVKTHEPASFNLNVTLKSSPDLLTYFCRASSTSGAHVDSARLQMHWELWSK
PVSELRANFTLQDRGAGPRVEMICQASSGSPPITNSLIGKDGQVHLQQRPCHRQPANFSFLP
SQTSDWFWCQAANNANVQHSALTVVPPGGDQKMEDWQGPLESPILALPLYRSTRRLSEEEFG
GFRIGNGEVRGRKAAAM

Signal Peptide:

amino acids 1-18

N-glycosylation Sites:

amino acids 86-89, 132-135, 181-184

FIGURE 152

GGTCCTTAATGGCAGCAGCCGCCGCTACCAAGATCCTTCTGTGCCTCCCGCTTCTGCTCCTG
CTGTCCGGCTGGTCCCGGGCTGGGCGAGCCGACCCTCACTCTCTTTGCTATGACATCACCGT
CATCCCTAAGTTCAGACCTGGACCACGGTGGTGTGCGGTTCAAGGCCAGGTGGATGAAAAGA
CTTTTCTTCACTATGACTGTGGCAACAAGACAGTCACACCTGTCAGTCCCCTGGGGAAGAAA
CTAAATGTCACAACGGCCTGGAAAGCACAGAACCCAGTACTGAGAGAGGTGGTGGACATACT
TACAGAGCAACTGCGTGACATTCAGCTGGAGAATTACACACCCAAGGAACCCCTCACCCTGC
AGGCAAGGATGTCTTGTGAGCAGAAAGCTGAAGGACACAGCAGTGGATCTTGGCAGTTCAGT
TTCGATGGGCAGATCTTCCTCCTCTTTGACTCAGAGAAGAGAATGTGGACAACGGTTCATCC
TGGAGCCAGAAAGATGAAAGAAAAGTGGGAGAATGACAAGGTTGTGGCCATGTCCTTCCATT
ACTTCTCAATGGGAGACTGTATAGGATGGCTTGAGGACTTCTTGATGGGCATGGACAGCACC
CTGGAGCCAAGTGCAGGAGCACCACTCGCCATGTCCTCAGGCACAACCCAACTCAGGGCCAC
AGCCACCACCCTCATCCTTTGCTGCCTCCTCATCATCCTCCCCTGCTTCATCCTCCCTGGCA
TCTGAGGAGAGTCCTTTAGAGTGACAGGTTAAAGCTGATACCAAAAGGCTCCTGTGAGCACG
GTCTTGATCAAACTCGCCCTTCTGTCTGGCCAGCTGCCCACGACCTACGGTGTATGTCCAGT
GGCCTCCAGCAGATCATGATGACATCATGGACCCAATAGCTCATTCACTGCCTTGATTCCTT
TTGCCAACAATTTTACCAGCAGTTATACCTAACATATTATGCAATTTTCTCTTGGTGCTACC
TGATGGAATTCCTGCACTTAAAGTTCTGGCTGACTAAACAAGATATATCATTTTCTTTCTTC
TCTTTTTGTTTGGAAAATCAAGTACTTCTTTGAATGATGATCTCTTTCTTGCAAATGATATT
GTCAGTAAAATAATCACGTTAGACTTCAGACCTCTGGGGATTCTTTCCGTGTCCTGAAAGAG
AATTTTTAAATTATTTAATAAGAAAAATTTATATTAATGATTGTTTCCTTTAGTAATTTAT
TGTTCTGTACTGATATTTAAATAAAGAGTTCTATTTCCCAAAAAAAAAAAAAAAAAA

FIGURE 153

MAAAAATKILLCLPLLLLLSGWSRAGRADPHSLCYDITVIPKFRPGPRWCAVQGQVDEKTFL
HYDCGNKTVTPVSPLGKKLNVTTAWKAQNPVLREVVDILTEQLRDIQLENYTPKEPLTLQAR
MSCEQKAEGHSSGSWQFSFDGQIFLLFDSEKRMWTTVHPGARKMKEKWENDKVVAMSFHYFS
MGDCIGWLEDFLMGMDSTLEPSAGAPLAMSSGTTQLRATATTLILCCLLIILPCFILPGI

Important features:

Signal peptide:

amino acids 1-25

Transmembrane domain:

amino acids 224-246

N-glycosylation site.

amino acids 68-72, 82-86

N-myristoylation site.

amino acids 200-206, 210-216

Amidation site.

amino acids 77-81

FIGURE 154

```
GGGAAAGCCATTTCGAAAACCCATCTATACAAACTATATATTTTCATTTCTGCTGCTAGCTG
CCTTGGGCCTCACAATTTTCATTCTGTTTTCTGACTTTCAAGTTATATACCGTGGAATGGAG
TTGATCCCAACCATAACATCGTGGAGGGTTTTAATTTTGGTGGTAGCCCTCACCCAATTCTG
GTGTGGCTTTCTTTGCAGAGGATTCCACCTTCAAAATCATGAACTCTGGCTGTTGATCAAAA
GAGAATTTGGATTCTACTCTAAAAGTCAATATAGGACTTGGCAAAAGAAGCTAGCAGAAGAC
TCAACCTGGCCTCCCATAAACAGGACAGATTATTCAGGTGATGGCAAAAATGGATTCTACAT
CAACGGAGGCTATGAAAGCCATGAACAGATTCCAAAAGAAAACTCAAATTGGGAGGCCAAC
CCACAGAACAGCATTTCTGGGCCAGGCTGTAATCAGAATTGTCGTCGTACATGCTCAACAGC
ATTGCTTTTTTCCCCAAAATTAACACATTGTGGAGAAGTGATGATACTCTCCCCTTACCTTT
CCTCTCTCCATTCAAGCATTCAAAGTATATTTTCAATGAATTAAACCTTGCAGCAAGGGACC
TTAGATAGGCTTATTCTGACTGTATGCTTTACCAATGAGAGAAAAAAATGCATTTCCTGTAT
CATCCTTTTCAATAAACTGTATTCATTTTGAAAAAAAAAAAAAAAAAAAAAA
```

FIGURE 155

MELIPTITSWRVLILVVALTQFWCGFLCRGFHLQNHELWLLIKREFGFYSKSQYRTWQKKLA
EDSTWPPINRTDYSGDGKNGFYINGGYESHEQIPKRKLKLGGQPTEQHFWARL

FIGURE 156

```
GTTCTCCTTTCCGAGCCAAAATCCCAGGCGATGGTGAATTATGAACGTGCCACACCATGAAG
CTCTTGTGGCAGGTAACTGTGCACCACCACACCTGGAATGCCATCCTGCTCCCGTTCGTCTA
CCTCACGGCGCAAGTGTGGATTCTGTGTGCAGCCATCGCTGCTGCCGCCTCAGCCGGGCCCC
AGAACTGCCCCTCCGTTTGCTCGTGCAGTAACCAGTTCAGCAAGGTGGTGTGCACGCGCCGG
GGCCTCTCCGAGGTCCCGCAGGGTATTCCCTCGAACACCCGGTACCTCAACCTCATGGAGAA
CAACATCCAGATGATCCAGGCCGACACCTTCCGCCACCTCCACCACCTGGAGGTCCTGCAGT
TGGGCAGGAACTCCATCCGGCAGATTGAGGTGGGGGCCTTCAACGGCCTGGCCAGCCTCAAC
ACCCTGGAGCTGTTCGACAACTGGCTGACAGTCATCCCTAGCGGGCCTTTGAATACCTGTC
CAAGCTGCGGGAGCTCTGGCTTCGCAACAACCCCATCGAAAGCATCCCCTCTTACGCCTTCA
ACCGGGTGCCCTCCCTCATGCGCCTGGACTTGGGGGAGCTCAAGAAGCTGGAGTATATCTCT
GAGGGAGCTTTTGAGGGGCTGTTCAACCTCAAGTATCTGAACTTGGGCATGTGCAACATTAA
AGACATGCCCAATCTCACCCCCCTGGTGGGGCTGGAGGAGCTGGAGATGTCAGGGAACCACT
TCCCTGAGATCAGGCCTGGCTCCTTCCATGGCCTGAGCTCCCTCAAGAAGCTCTGGGTCATG
AACTCACAGGTCAGCCTGATTGAGCGGAATGCTTTTGACGGGCTGGCTTCACTTGTGGAACT
CAACTTGGCCCACAATAACCTCTCTTCTTTGCCCCATGACCTCTTTACCCCGCTGAGGTACC
TGGTGGAGTTGCATCTACACCACAACCCTTGGAACTGTGATTGTGACATTCTGTGGCTAGCC
TGGTGGCTTCGAGAGTATATACCCACCAATTCCACCTGCTGTGGCCGCTGTCATGCTCCCAT
GCACATGCGAGGCCGCTACCTCGTGGAGGTGGACCAGGCCTCCTTCCAGTGCTCTGCCCCCT
TCATCATGGACGCACCTCGAGACCTCAACATTTCTGAGGGTCGGATGGCAGAACTTAAGTGT
CGGACTCCCCCTATGTCCTCCGTGAAGTGGTTGCTGCCCAATGGGACAGTGCTCAGCCACGC
CTCCCGCCACCCAAGGATCTCTGTCCTCAACGACGGCACCTTGAACTTTTCCCACGTGCTGC
TTTCAGACACTGGGGTGTACACATGCATGGTGACCAATGTTGCAGGCAACTCCAACGCCTCG
GCCTACCTCAATGTGAGCACGGCTGAGCTTAACACCTCCAACTACAGCTTCTTCACCACAGT
AACAGTGGAGACCACGGAGATCTCGCCTGAGGACACAACGCGAAAGTACAAGCCTGTTCCTA
CCACGTCCACTGGTTACCAGCCGGCATATACCACCTCTACCACGGTGCTCATTCAGACTACC
CGTGTGCCCAAGCAGGTGGCAGTACCCGCGACAGACACCACTGACAAGATGCAGACCAGCCT
GGATGAAGTCATGAAGACCACCAAGATCATCATTGGCTGCTTTGTGGCAGTGACTCTGCTAG
CTGCCGCCATGTTGATTGTCTTCTATAAACTTCGTAAGCGGCACCAGCAGCGGAGTACAGTC
ACAGCCGCCCGGACTGTTGAGATAATCCAGGTGGACGAAGACATCCCAGCAGCAACATCCGC
AGCAGCAACAGCAGCTCCGTCCGGTGTATCAGGTGAGGGGCAGTAGTGCTGCCCACAATTC
ATGACCATATTAACTACAACACCTACAAACCAGCACATGGGGCCCACTGGACAGAAAACAGC
CTGGGGAACTCTCTGCACCCCACAGTCACCACTATCTCTGAACCTTATATAATTCAGACCCA
TACCAAGGACAAGGTACAGGAAACTCAAATATGACTCCCCTCCCCAAAAAACTTATAAAAT
GCAATAGAATGCACACAAAGACAGCAACTTTTGTACAGAGTGGGGAGAGACTTTTTCTTGTA
TATGCTTATATATTAAGTCTATGGGCTGGTTAAAAAAAACAGATTATATTAAAATTTAAAGA
CAAAAAGTCAAAACA
```

FIGURE 157

MKLLWQVTVHHHTWNAILLPFVYLTAQVWILCAAIAAAASAGPQNCPSVCSCSNQFSKVVCT
RRGLSEVPQGIPSNTRYLNLMENNIQMIQADTFRHLHHLEVLQLGRNSIRQIEVGAFNGLAS
LNTLELFDNWLTVIPSGAFEYLSKLRELWLRNNPIESIPSYAFNRVPSLMRLDLGELKKLEY
ISEGAFEGLFNLKYLNLGMCNIKDMPNLTPLVGLEELEMSGNHFPEIRPGSFHGLSSLKKLW
VMNSQVSLIERNAFDGLASLVELNLAHNNLSSLPHDLFTPLRYLVELHLHHNPWNCDCDILW
LAWWLREYIPTNSTCCGRCHAPMHMRGRYLVEVDQASFQCSAPFIMDAPRDLNISEGRMAEL
KCRTPPMSSVKWLLPNGTVLSHASRHPRISVLNDGTLNFSHVLLSDTGVYTCMVTNVAGNSN
ASAYLNVSTAELNTSNYSFFTTVTVETTEISPEDTTRKYKPVPTTSTGYQPAYTTSTTVLIQ
TTRVPKQVAVPATDTTDKMQTSLDEVMKTTKIIIGCFVAVTLLAAAMLIVFYKLRKRHQQRS
TVTAARTVEIIQVDEDIPAATSAAATAAPSGVSGEGAVVLPTIHDHINYNTYKPAHGAHWTE
NSLGNSLHPTVTTISEPYIIQTHTKDKVQETQI

FIGURE 158

```
CGCTCGGGCACCAGCCGCGGCAAGGATGGAGCTGGGTTGCTGGACGCAGTTGGGGCTCACTTTTCTTCAGCTCC
TTCTCATCTCGTCCTTGCCAAGAGAGTACACAGTCATTAATGAAGCCTGCCCTGGAGCAGAGTGGAATATCATG
TGTCGGGAGTGCTGTGAATATGATCAGATTGAGTGCGTCTGCCCCGGAAAGAGGGAAGTCGTGGGTTATACCAT
CCCTTGCTGCAGGAATGAGGAGAATGAGTGTGACTCCTGCCTGATCCACCCAGGTTGTACCATCTTTGAAAACT
GCAAGAGCTGCCGAAATGGCTCATGGGGGGGTACCTTGGATGACTTCTATGTGAAGGGGTTCTACTGTGCAGAG
TGCCGAGCAGGCTGGTACGGAGGAGACTGCATGCCATGTGGCCAGGTTCTGCGAGCCCCAAAGGGTCAGATTTT
GTTGGAAAGCTATCCCTAAATGCTCACTGTGAATGGACCATTCATGCTAAACCTGGGTTTGTCATCCAACTAA
GATTTGTCATGTTGAGTCTGGAGTTTGACTACATGTGCCAGTATGACTATGTTGAGGTTCGTGATGGAGACAAC
CGCGATGGCCAGATCATCAAGCGTGTCTGTGGCAACGAGCGGCCAGCTCCTATCCAGAGCATAGGATCCTCACT
CCACGTCCTCTTCCACTCCGATGGCTCCAAGAATTTTGACGGTTTCCATGCCATTTATGAGGAGATCACAGCAT
GCTCCTCATCCCCTTGTTTCCATGACGGCACGTGCGTCCTTGACAAGGCTGGATCTTACAAGTGTGCCTGCTTG
GCAGGCTATACTGGGCAGCGCTGTGAAAATCTCCTTGAAGAAAGAAACTGCTCAGACCCTGGGGGCCCAGTCAA
TGGGTACCAGAAAATAACAGGGGGCCCTGGGCTTATCAACGGACGCCATGCTAAAATTGGCACCGTGGTGTCTT
TCTTTTGTAACAACTCCTATGTTCTTAGTGGCAATGAGAAAGAACTTGCCAGCAGAATGGAGAGTGGTCAGGG
AAACAGCCCATCTGCATAAAAGCCTGCCGAGAACCAAAGATTTCAGACCTGGTGAGAAGGAGAGTTCTTCCGAT
GCAGGTTCAGTCAAGGGAGACACCATTACACCAGCTATACTCAGCGGCCTTCAGCAAGCAGAAACTGCAGAGTG
CCCCTACCAAGAAGCCAGCCCTTCCCTTTGGAGATCTGCCCATGGGATACCAACATCTGCATACCCAGCTCCAG
TATGAGTGCATCTCACCCTTCTACCGCCGCCTGGGCAGCAGCAGGAGGACATGTCTGAGGACTGGGAAGTGGAG
TGGGCGGGCACCATCCTGCATCCCTATCTGCGGGAAAATTGAGAACATCACTGCTCCAAAGACCCAAGGGTTGC
GCTGGCCGTGGCAGGCAGCCATCTACAGGAGGACCAGCGGGGTGCATGACGGCAGCCTACACAAGGGAGCGTGG
TTCCTAGTCTGCAGCGGTGCCCTGGTGAATGAGCGCACTGTGGTGGTGGCTGCCCACTGTGTTACTGACCTGGG
GAAGGTCACCATGATCAAGACAGCAGACCTGAAAGTTGTTTTGGGGAAATTCTACCGGGATGATGACCGGGATG
AGAAGACCATCCAGAGCCTACAGATTTCTGCTATCATTCTGCATCCCAACTATGACCCCATCCTGCTTGATGCT
GACATCGCCATCCTGAAGCTCCTAGACAAGGCCCGTATCAGCACCCGAGTCCAGCCCATCTGCCTCGCTGCCAG
TCGGGATCTGCAGCACTTCCTTCCAGGAGTCCCACATCACTGTGGCTGGCTGGAATGTCCTGGCAGACGTGAGGA
GCCCTGGCTTCAAGAACGACACACTGCGCTCTGGGGTGGTCAGTGTGGTGGACTCGCTGCTGTGTGAGGAGCAG
CATGAGGACCATGGCATCCCACTGAGTGTCACTGATAACATGTTCTGTGCCAGCTGGGAACCCACTGCCCCTTC
TGATATCTGCACTGCAGAGACAGGAGGCATCGCGGCTGTGTCCTTCCCGGGACGAGCATCTCCTGAGCCACGCT
GGCATCTGATGGGACTGGTCAGCTGGAGCTATGATAAAACATGCAGCCACAGGCTCTCCACTGCCTTCACCAAG
GTGCTGCCTTTTAAAGACTGGATTGAAAGAAATATGAAATGAACCATGCTCATGCACTCCTTGAGAAGTGTTTC
TGTATATCCGTCTGTACGTGTGTCATTGCGTGAAGCAGTGTGGGCCTGAAGTGTGATTTGGCCTGTGAACTTGG
CTGTGCCAGGGCTTCTGACTTCAGGGACAAAACTCAGTGAAGGGTGAGTAGACCTCCATTGCTGGTAGGCTGAT
GCCGCGTCCACTACTAGGACAGCCAATTGGAAGATGCCAGGGCTTGCAAGAAGTAAGTTTCTTCAAAGAAGACC
ATATACAAAACCTCTCCACTCCACTGACCTGGTGGTCTTCCCCAACTTTCAGTTATACGAATGCCATCAGCTTG
ACCAGGGAAGATCTGGGCTTCATGAGGCCCCTTTTGAGGCTCTCAAGTTCTAGAGAGCTGCCTGTGGGACAGCC
CAGGGCAGCAGAGCTGGGATGTGGTGCATGCCTTTGTGTACATGGCCACAGTACAGTCTGGTCCTTTTCCTTCC
CCATCTCTTGTACACATTTTAATAAAATAAGGGTTGGCTTCTGAACTACAAAAAAAAAAAAAAAAAAAAAAAAAA
AAAAAAAAAAAAAAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAA
```

FIGURE 159

```
MELGCWTQLGLTFLQLLLISSLPREYTVINEACPGAEWNIMCRECCEYDQIECVCPGKREVV
GYTIPCCRNEENECDSCLIHPGCTIFENCKSCRNGSWGGTLDDFYVKGFYCAECRAGWYGGD
CMRCGQVLRAPKGQILLESYPLNAHCEWTIHAKPGFVIQLRFVMLSLEFDYMCQYDYVEVRD
GDNRDGQIIKRVCGNERPAPIQSIGSSLHVLFHSDGSKNFDGFHAIYEEITACSSSPCFHDG
TCVLDKAGSYKCACLAGYTGQRCENLLEERNCSDPGGPVNGYQKITGGPGLINGRHAKIGTV
VSFFCNNSYVLSGNEKRTCQQNGEWSGKQPICIKACREPKISDLVRRRVLPMQVQSRETPLH
QLYSAAFSKQKLQSAPTKKPALPFGDLPMGYQHLHTQLQYECISPFYRRLGSSRRTCLRTGK
WSGRAPSCIPICGKIENITAPKTQGLRWPWQAAIYRRTSGVHDGSLHKGAWFLVCSGALVNE
RTVVVAAHCVTDLGKVTMIKTADLKVVLGKFYRDDDRDEKTIQSLQISAIILHPNYDPILLD
ADIAILKLLDKARISTRVQPICLAASRDLSTSFQESHITVAGWNVLADVRSPGFKNDTLRSG
VVSVVDSLLCEEQHEDHGIPVSVTDNMFCASWEPTAPSDICTAETGGIAAVSFPGRASPEPR
WHLMGLVSWSYDKTCSHRLSTAFTKVLPFKDWIERNMK
```

FIGURE 160

ACCAGGCATTGTATCTTCAGTTGTCATCAAGTTCGCAATCAGATTGGAAAAGCTCAACTTGA
AGCTTTCTTGCCTGCAGTGAAGCAGAGAGATAGATATTATTCACGTAATAAAAAACATGGGC
TTCAACCTGACTTTCCACCTTTCCTACAAATTCCGATTACTGTTGCTGTTGACTTTGTGCCT
GACAGTGGTTGGGTGGGCCACCAGTAACTACTTCGTGGGTGCCATTCAAGAGATTCCTAAAG
CAAAGGAGTTCATGGCTAATTTCCATAAGACCCTCATTTTGGGGAAGGGAAAAACTCTGACT
AATGAAGCATCCACGAAGAAGGTAGAACTTGACAACTGTCCTTCTGTGTCTCCTTACCTCAG
AGGCCAGAGCAAGCTCATTTTCAAACCAGATCTCACTTTGGAAGAGGTACAGGCAGAAAATC
CCAAAGTGTCCAGAGGCCGGTATCGCCCTCAGGAATGTAAAGCTTTACAGAGGGTCGCCATC
CTCGTTCCCCACCGGAACAGAGAGAAACACCTGATGTACCTGCTGGAACATCTGCATCCCTT
CCTGCAGAGGCAGCAGCTGGATTATGGCATCTACGTCATCCACCAGGCTGAAGGTAAAAAGT
TTAATCGAGCCAAACTCTTGAATGTGGGCTATCTAGAAGCCCTCAAGGAAGAAAATTGGGAC
TGCTTTATATTCCACGATGTGGACCTGGTACCCGAGAATGACTTTAACCTTTACAAGTGTGA
GGAGCATCCCAAGCATCTGGTGGTTGGCAGGAACAGCACTGGGTACAGGTTACGTTACAGTG
GATATTTTGGGGGTGTTACTGCCCTAAGCAGAGAGCAGTTTTTCAAGGTGAATGGATTCTCT
AACAACTACTGGGGATGGGGAGGCGAAGACGATGACCTCAGACTCAGGGTTGAGCTCCAAAG
AATGAAAATTTCCCGGCCCCTGCCTGAAGTGGGTAAATATACAATGGTCTTCCACACTAGAG
ACAAAGGCAATGAGGTGAACGCAGAACGGATGAAGCTCTTACACCAAGTGTCACGAGTCTGG
AGAACAGATGGGTTGAGTAGTTGTTCTTATAAATTAGTATCTGTGGAACACAATCCTTTATA
TATCAACATCACAGTGGATTTCTGGTTTGGTGCATGACCCTGGATCTTTTGGTGATGTTTGG
AAGAACTGATTCTTTGTTTGCAATAATTTTGGCCTAGAGACTTCAAATAGTAGCACACATTA
AGAACCTGTTACAGCTCATTGTTGAGCTGAATTTTTCCTTTTTGTATTTTCTTAGCAGAGCT
CCTGGTGATGTAGAGTATAAAACAGTTGTAACAAGACAGCTTTCTTAGTCATTTTGATCATG
AGGGTTAAATATTGTAATATGGATACTTGAAGGACTTTATATAAAAGGATGACTCAAAGGAT
AAAATGAACGCTATTTGAGGACTCTGGTTGAAGGAGATTTATTTAAATTTGAAGTAATATAT
TATGGGATAAAAGGCCACAGGAAATAAGACTGCTGAATGTCTGAGAGAACCAGAGTTGTTCT
CGTCCAAGGTAGAAAGGTACGAAGATACAATACTGTTATTCATTTATCCTGTACAATCATCT
GTGAAGTGGTGGTGTCAGGTGAGAAGGCGTCCACAAAAGAGGGGAGAAAAGGCGACGAATCA
GGACACAGTGAACTTGGGAATGAAGAGGTAGCAGGAGGGTGGAGTGTCGGCTGCAAAGGCAG
CAGTAGCTGAGCTGGTTGCAGGTGCTGATAGCCTTCAGGGGAGGACCTGCCCAGGTATGCCT
TCCAGTGATGCCCACCAGAGAATACATTCTCTATTAGTTTTTAAAGAGTTTTTGTAAAATGA
TTTTGTACAAGTAGGATATGAATTAGCAGTTTACAAGTTTACATATTAACTAATAATAAATA
TGTCTATCAAATACCTCTGTAGTAAAATGTGAAAAGCAAAA

FIGURE 161

MGFNLTFHLSYKFRLLLLLTLCLTVVGWATSNYFVGAIQEIPKAKEFMANFHKTLILGKGKT
LTNEASTKKVELDNCPSVSPYLRGQSKLIFKPDLTLEEVQAENPKVSRGRYRPQECKALQRV
AILVPHRNREKHLMYLLEHLHPFLQRQQLDYGIYVIHQAEGKKFNRAKLLNVGYLEALKEEN
WDCFIFHDVDLVPENDFNLYKCEEHPKHLVVGRNSTGYRLRYSGYFGGVTALSREQFFKVNG
FSNNYWGWGGEDDDLRLRVELQRMKISRPLPEVGKYTMVFHTRDKGNEVNAERMKLLHQVSR
VWRTDGLSSCSYKLVSVEHNPLYINITVDFWFGA

Important features:

Signal peptide:

amino acids 1-27

N-glycosylation sites:

amino acids 4-7, 220-223 and 335-338

Xylose isomerase proteins:

amino acids 191-201

FIGURE 162

CGTGGGCCGGGGTCGCGCAGCGGGCTGTGGGCGCGCCCGGAGGAGCGACCGCCGCAGTTCTC
GAGCTCCAGCTGCATTCCCTCCGCGTCCGCCCCACGCTTCTCCCGCTCCGGGCCCCGCAATG
GCCCAGGCAGTGTGGTCGCGCCTCGGCCGCATCCTCTGGCTTGCCTGCCTCCTGCCCTGGGC
CCCGGCAGGGGTGGCCGCAGGCCTGTATGAACTCAATCTCACCACCGATAGCCCTGCCACCA
CGGGAGCGGTGGTGACCATCTCGGCCAGCCTGGTGGCCAAGGACAACGGCAGCCTGGCCCTG
CCCGCTGACGCCCACCTCTACCGCTTCCACTGGATCCACACCCCGCTGGTGCTTACTGGCAA
GATGGAGAAGGGTCTCAGCTCCACCATCCGTGTGGTCGGCCACGTGCCCGGGGAATTCCCGG
TCTCTGTCTGGGTCACTGCCGCTGACTGCTGGATGTGCCAGCCTGTGGCCAGGGCTTTGTG
GTCCTCCCCATCACAGAGTTCCTCGTGGGGACCTTGTTGTCACCCAGAACACTTCCCTACC
CTGGCCCAGCTCCTATCTCACTAAGACCGTCCTGAAAGTCTCCTTCCTCCTCCACGACCCGA
GCAACTTCCTCAAGACCGCCTTGTTTCTCTACAGCTGGGACTTCGGGGACGGGACCCAGATG
GTGACTGAAGACTCCGTGGTCTATTATAACTATTCCATCATCGGGACCTTCACCGTGAAGCT
CAAAGTGGTGGCGGAGTGGGAAGAGGTGGAGCCGGATGCCACGAGGGCTGTGAAGCAGAAGA
CCGGGGACTTCTCCGCCTCGCTGAAGCTGCAGGAAACCCTTCGAGGCATCCAAGTGTTGGGG
CCCACCCTAATTCAGACCTTCCAAAAGATGACCGTGACCTTGAACTTCCTGGGGAGCCCTCC
TCTGACTGTGTGCTGGCGTCTCAAGCCTGAGTGCCTCCCGCTGGAGGAAGGGGAGTGCCACC
CTGTGTCCGTGGCCAGCACAGCGTACAACCTGACCCACACCTTCAGGGACCCTGGGGACTAC
TGCTTCAGCATCCGGGCCGAGAATATCATCAGCAAGACACATCAGTACCACAAGATCCAGGT
GTGGCCCTCCAGAATCCAGCCGGCTGTCTTTGCTTTCCCATGTGCTACACTTATCACTGTGA
TGTTGGCCTTCATCATGTACATGACCCTGCGGAATGCCACTCAGCAAAAGGACATGGTGGAG
AACCCGGAGCCACCCTCTGGGGTCAGGTGCTGCTGCCAGATGTGCTGTGGGCCTTTCTTGCT
GGAGACTCCATCTGAGTACCTGGAAATTGTTCGTGAGAACCACGGGCTGCTCCCGCCCCTCT
ATAAGTCTGTCAAAACTTACACCGTGTGAGCACTCCCCCTCCCCACCCCATCTCAGTGTTAA
CTGACTGCTGACTTGGAGTTTCCAGCAGGGTGGTGTGCACCACTGACCAGGAGGGGTTCATT
TGCGTGGGGCTGTTGGCCTGGATCATCCATCCATCTGTACAGTTCAGCCACTGCCACAAGCC
CCTCCCTCTCTGTCACCCCTGACCCCAGCCATTCACCCATCTGTACAGTCCAGCCACTGACA
TAAGCCCCACTCGGTTACCACCCCCTTGACCCCCTACCTTTGAAGAGGCTTCGTGCAGGACT
TTGATGCTTGGGGTGTTCCGTGTTGACTCCTAGGTGGGCCTGGCTGCCCACTGCCCATTCCT
CTCATATTGGCACATCTGCTGTCCATTGGGGGTTCTCAGTTTCCTCCCCAGACAGCCCTAC
CTGTGCCAGAGAGCTAGAAAGAAGGTCATAAAGGGTTAAAAATCCATAACTAAAGGTTGTAC
ACATAGATGGGCACACTCACAGAGAGAAGTGTGCATGTACACACACCACACACACACACACA
CACACACACACAGAAATATAAACACATGCGTCACATGGGCATTTCAGATGATCAGCTCTGTA
TCTGGTTAAGTCGGTTGCTGGGATGCACCCTGCACTAGAGCTGAAAGGAAATTTGACCTCCA
AGCAGCCCTGACAGGTTCTGGGCCCGGGCCCTCCCTTTGTGCTTTGTCTCTGCAGTTCTTGC
GCCCTTTATAAGGCCATCCTAGTCCCTGCTGGCTGGCAGGGCCTGGATGGGGGCAGGACT
AATACTGAGTGATTGCAGAGTGCTTTATAAATATCACCTTATTTTATCGAAACCCATCTGTG
AAACTTTCACTGAGGAAAAGGCCTTGCAGCGGTAGAAGAGGTTGAGTCAAGGCCGGGCGCGG
TGGCTCACGCCTGTAATCCCAGCACTTTGGGAGGCCGAGGCGGGTGGATCACGAGATCAGGA
GATCGAGACCACCCTGGCTAACACGGTGAAACCCCGTCTCTACTAAAAAATACAAAAAGTT
AGCCGGGCGTGGTGGTGGGTGCCTGTAGTCCCAGCTACTCGGGAGGCTGAGGCAGGAGAATG
GTGCGAACCCGGGAGGCGGAGCTTGCAGTGAGCCCAGATGGCGCCACTGCACTCCAGCCTGA
GTGACAGAGCGAGACTCTGTCTCCA

FIGURE 163

MAQAVWSRLGRILWLACLLPWAPAGVAAGLYELNLTTDSPATTGAVVTISASLVAKDNGSLA
LPADAHLYRFHWIHTPLVLTGKMEKGLSSTIRVVGHVPGEFPVSVWVTAADCWMCQPVARGF
VVLPITEFLVGDLVVTQNTSLPWPSSYLTKTVLKVSFLLHDPSNFLKTALFLYSWDFGDGTQ
MVTEDSVVYYNYSIIGTFTVKLKVVAEWEEVEPDATRAVKQKTGDFSASLKLQETLRGIQVL
GPTLIQTFQKMTVTLNFLGSPPLTVCWRLKPECLPLEEGECHPVSVASTAYNLTHTFRDPGD
YCFSIRAENIISKTHQYHKIQVWPSRIQPAVFAFPCATLITVMLAFIMYMTLRNATQQKDMV
ENPEPPSGVRCCCQMCCGPFLLETPSEYLEIVRENHGLLPPLYKSVKTYTV

Important features of the protein:
Signal peptide:
amino acids 1-24

Transmembrane domain:
amino acids 339-362

N-glycosylation sites.
amino acids 34-37, 58-61, 142-145, 197-200, 300-303 and 364-367

FIGURE 164

GCTCAAGACCCAGCAGTGGGACAGCCAGACAGACGGCACGATGGCACTGAGCTCCCAGATCT
GGGCCGCTTGCCTCCTGCTCCTCCTCCTCGCCAGCCTGACCAGTGGCTCTGTTTTCCCA
CAACAGACGGGACAACTTGCAGAGCTGCAACCCCAGGACAGAGCTGGAGCCAGGGCCAGCTG
GATGCCCATGTTCCAGAGGCGAAGGAGGCGAGACACCCACTTCCCCATCTGCATTTTCTGCT
GCGGCTGCTGTCATCGATCAAAGTGTGGGATGTGCTGCAAGACGTAGAACCTACCTGCCCTG
CCCCCGTCCCCTCCCTTCCTTATTTATTCCTGCTGCCCCAGAACATAGGTCTTGGAATAAAA
TGGCTGGTTCTTTTGTTTTCCAAAAAAAAAAAAAAAAAAAAAAAAAAAAAAAAAAAAAAAA
AAAAAAAAAAAAAAAAAAAAAAAAAAAAAAAAAAAAAAAAAAAAAA

FIGURE 165

MALSSQIWAACLLLLLLLLASLTSGSVFPQQTGQLAELQPQDRAGARASWMPMFQRRRRRDTH
FPICIFCCGCCHRSKCGMCCKT

FIGURE 166

```
CTGTCAGGAAGGACCATCTGAAGGCTGCAATTTGTTCTTAGGGAGGCAGGTGCTGGCCTGGC
CTGGATCTTCCACCATGTTCCTGTTGCTGCCTTTTGATAGCCTGATTGTCAACCTTCTGGGC
ATCTCCCTGACTGTCCTCTTCACCCTCCTTCTCGTTTTCATCATAGTGCCAGCCATTTTTGG
AGTCTCCTTTGGTATCCGCAAACTCTACATGAAAAGTCTGTTAAAAATCTTTGCGTGGGCTA
CCTTGAGAATGGAGCGAGGAGCCAAGGAGAAGAACCACCAGCTTTACAAGCCCTACACCAAC
GGAATCATTGCAAAGGATCCCACTTCACTAGAAGAAGAGATCAAAGAGATTCGTCGAAGTGG
TAGTAGTAAGGCTCTGGACAACACTCCAGAGTTCGAGCTCTCTGACATTTTCTACTTTTGCC
GGAAAGGAATGGAGACCATTATGGATGATGAGGTGACAAAGAGATTCTCAGCAGAAGAACTG
GAGTCCTGGAACCTGCTGAGCAGAACCAATTATAACTTCCAGTACATCAGCCTTCGGCTCAC
GGTCCTGTGGGGGTTAGGAGTGCTGATTCGGTACTGCTTTCTGCTGCCGCTCAGGATAGCAC
TGGCTTTCACAGGGATTAGCCTTCTGGTGGTGGGCACAACTGTGGTGGGATACTTGCCAAAT
GGGAGGTTTAAGGAATTCATGAGTAAACATGTTCACTTAATGTGTTACCGGATCTGCGTGCG
AGCGCTGACAGCCATCATCACCTACCATGACAGGGAAAACAGACCAAGAAATGGTGGCATCT
GTGTGGCCAATCATACCTCACCGATCGATGTGATCATCTTGGCCAGCGATGGCTATTATGCC
ATGGTGGGTCAAGTGCACGGGGACTCATGGGTGTGATTCAGAGAGCCATGGTGAAGGCCTG
CCCACACGTCTGGTTTGAGCGCTCGGAAGTGAAGGATCGCCACCTGGTGGCTAAGAGACTGA
CTGAACATGTGCAAGATAAAAGCAAGCTGCCTATCCTCATCTTCCCAGAAGGAACCTGCATC
AATAATACATCGGTGATGATGTTCAAAAAGGGAAGTTTTGAAATTGGAGCCACAGTTTACCC
TGTTGCTATCAAGTATGACCCTCAATTTGGCGATGCCTTCTGGAACAGCAGCAAATACGGGA
TGGTGACGTACCTGCTGCGAATGATGACCAGCTGGGCCATTGTCTGCAGCGTGTGGTACCTG
CCTCCCATGACTAGAGAGGCAGATGAAGATGCTGTCCAGTTTGCGAATAGGGTGAAATCTGC
CATTGCCAGGCAGGGAGGACTTGTGGACCTGCTGTGGGATGGGGGCCTGAAGAGGGAGAAGG
TGAAGGACACGTTCAAGGAGGAGCAGCAGAAGCTGTACAGCAAGATGATCGTGGGGAACCAC
AAGGACAGGAGCCGCTCCTGAGCCTGCCTCCAGCTGGCTGGGGCCACCGTGCGGGGTGCCAA
CGGGCTCAGAGCTGGAGTTGCCGCCGCCGCCCCACTGCTGTGTCCTTTCCAGACTCCAGGG
CTCCCCGGGCTGCTCTGGATCCCAGGACTCCGGCTTTCGCCGAGCCGCAGCGGGATCCCTGT
GCACCCGGCGCAGCCTACCCTTGGTGGTCTAAACGGATGCTGCTGGGTGTTGCGACCCAGGA
CGAGATGCCTTGTTTCTTTTACAATAAGTCGTTGGAGGAATGCCATTAAAGTGAACTCCCCA
CCTTTGCACGCTGTGCGGGCTGAGTGGTTGGGGAGATGTGGCCATGGTCTTGTGCTAGAGAT
GGCGGTACAAGAGTCTGTTATGCAAGCCCGTGTGCCAGGGATGTGCTGGGGCGGCCACCCG
CTCTCCAGGAAAGGCACAGCTGAGGCACTGTGGCTGGCTTCGGCCTCAACATCGCCCCCAGC
CTTGGAGCTCTGCAGACATGATAGGAAGGAAACTGTCATCTGCAGGGGCTTTCAGCAAAATG
AAGGGTTAGATTTTTATGCTGCTGCTGATGGGGTTACTAAAGGGAGGGGAAGAGGCCAGGTG
GGCCGCTGACTGGGCCATGGGGAGAACGTGTGTTCGTACTCCAGGCTAACCCTGAACTCCCC
ATGTGATGCGCGCTTTGTTAATGTGTGTCTCGGTTTCCCCATCTGTAATATGAGTCGGGGG
GAATGGTGGTGATTCCTACCTCACAGGGCTGTTGTGGGATTAAAGTGCTGCGGGTGAGTGA
AGGACACATCACGTTCAGTGTTTCAAGTACAGGCCCACAAAACGGGGCACGGCAGGCCTGAG
CTCAGAGCTGCTGCACTGGGCTTTGGATTTGTTCTTGTGAGTAAATAAAACTGGCTGGTGAA
TGA
```

FIGURE 167

```
MFLLLPFDSLIVNLLGISLTVLFTLLLVFIIVPAIFGVSFGIRKLYMKSLLKIFAWATLRME
RGAKEKNHQLYKPYTNGIIAKDPTSLEEEIKEIRRSGSSKALDNTPEFELSDIFYFCRKGME
TIMDDEVTKRFSAEELESWNLLSRTNYNFQYISLRLTVLWGLGVLIRYCFLLPLRIALAFTG
ISLLVVGTTVVGYLPNGRFKEFMSKHVHLMCYRICVRALTAIITYHDRENRPRNGGICVANH
TSPIDVIILASDGYYAMVGQVHGGLMGVIQRAMVKACPHVWFERSEVKDRHLVAKRLTEHVQ
DKSKLPILIFPEGTCINNTSVMMFKKGSFEIGATVYPVAIKYDPQFGDAFWNSSKYGMVTYL
LRMMTSWAIVCSVWYLPPMTREADEDAVQFANRVKSAIARQGGLVDLLWDGGLKREKVKDTF
KEEQQKLYSKMIVGNHKDRSRS
```

FIGURE 168

```
GCCCCTCGAAACCAGGACTCCAGCACCTCTGGTCCCGCCCTCACCCGGACCCCTGGCCCTCA
CGTCTCCTCCAGGGATGGCGCTGGCGGCTTTGATGATCGCCCTCGGCAGCCTCGGCCTCCAC
ACCTGGCAGGCCCAGGCTGTTCCCACCATCCTGCCCCTGGGCCTGGCTCCAGACACCTTTGA
CGATACCTATGTGGGTTGTGCAGAGGAGATGGAGGAGAAGGCAGCCCCCCTGCTAAAGGAGG
AAATGGCCCACCATGCCCTGCTGCGGGAATCCTGGGAGGCAGCCCAGGAGACCTGGGAGGAC
AAGCGTCGAGGGCTTACCTTGCCCCCTGGCTTCAAAGCCCAGAATGGAATAGCCATTATGGT
CTACACCAACTCATCGAACACCTTGTACTGGGAGTTGAATCAGGCCGTGCGGACGGGCGGAG
GCTCCCGGGAGCTCTACATGAGGCACTTTCCCTTCAAGGCCCTGCATTTCTACCTGATCCGG
GCCCTGCAGCTGCTGCGAGGCAGTGGGGCTGCAGCAGGGACCTGGGGAGGTGGTGTTCCG
AGGTGTGGGCAGCCTTCGCTTTGAACCCAAGAGGCTGGGGGACTCTGTCCGCTTGGGCCAGT
TTGCCTCCAGCTCCCTGGATAAGGCAGTGGCCCACAGATTTGGGGAGAAGAGGCGGGGCTGT
GTGTCTGCGCCAGGGGTGCAGCTAGGGTCACAATCTGAGGGGGCCTCCTCTCTGCCCCCTG
GAAGACTCTGCTCTTGGCCCCTGGAGAGTTCCAGCTCTCAGGGGTTGGGCCCTGAAAGTCCA
ACATCTGCCACTTAGGAGCCCTGGGAACGGGTGACCTTCATATGACGAAGAGGCACCTCCAG
CAGCCTTGAGAAGCAAGAACATGGTTCCGGACCCAGCCCTAGCAGCCTTCTCCCCAACCAGG
ATGTTGGCCTGGGGAGGCCACAGCAGGGCTGAGGGAACTCTGCTATGTGATGGGGACTTCCT
GGGACAAGCAAGGAAAGTACTGAGGCAGCCACTTGATTGAACGGTGTTGCAATGTGGAGACA
TGGAGTTTTATTGAGGTAGCTACGTGATTAAATGGTATTGCAGTGTGGA
```

FIGURE 169

```
MALAALMIALGSLGLHTWQAQAVPTILPLGLAPDTFDDTYVGCAEEMEEKAAPLLKEEMAHH
ALLRESWEAAQETWEDKRRGLTLPPGFKAQNGIAIMVYTNSSNTLYWELNQAVRTGGGSREL
YMRHFPFKALHFYLIRALQLLRGSGGCSRGPGEVVFRGVGSLRFEPKRLGDSVRLGQFASSS
LDKAVAHRFGEKRRGCVSAPGVQLGSQSEGASSLPPWKTLLLAPGEFQLSGVGP
```

FIGURE 170

```
GTGGCTTCATTTCAGTGGCTGACTTCCAGAGAGCAATATGGCTGGTTCCCCAACATGCCTCA
CCCTCATCTATATCCTTTGGCAGCTCACAGGGTCAGCAGCCTCTGGACCCGTGAAAGAGCTG
GTCGGTTCCGTTGGTGGGGCCGTGACTTTCCCCCTGAAGTCCAAAGTAAAGCAAGTTGACTC
TATTGTCTGGACCTTCAACACAACCCCTCTTGTCACCATACAGCCAGAAGGGGGCACTATCA
TAGTGACCCAAAATCGTAATAGGGAGAGAGTAGACTTCCCAGATGGAGGCTACTCCCTGAAG
CTCAGCAAACTGAAGAAGAATGACTCAGGGATCTACTATGTGGGGATATACAGCTCATCACT
CCAGCAGCCCTCCACCCAGGAGTACGTGCTGCATGTCTACGAGCACCTGTCAAAGCCTAAAG
TCACCATGGGTCTGCAGAGCAATAAGAATGGCACCTGTGTGACCAATCTGACATGCTGCATG
GAACATGGGGAAGAGGATGTGATTTATACCTGGAAGGCCCTGGGGCAAGCAGCCAATGAGTC
CCATAATGGGTCCATCCTCCCCATCTCCTGGAGATGGGGAGAAAGTGATATGACCTTCATCT
GCGTTGCCAGGAACCCTGTCAGCAGAAACTTCTCAAGCCCCATCCTTGCCAGGAAGCTCTGT
GAAGGTGCTGCTGATGACCCAGATTCCTCCATGGTCCTCCTGTGTCTCCTGTTGGTGCCCCT
CCTGCTCAGTCTCTTTGTACTGGGGCTATTTCTTTGGTTTCTGAAGAGAGAGAGACAAGAAG
AGTACATTGAAGAGAAGAAGAGAGTGGACATTTGTCGGGAAACTCCTAACATATGCCCCCAT
TCTGGAGAGAACACAGAGTACGACACAATCCCTCACACTAATAGAACAATCCTAAAGGAAGA
TCCAGCAAATACGGTTTACTCCACTGTGGAAATACCGAAAAGATGGAAAATCCCCACTCAC
TGCTCACGATGCCAGACACACCAAGGCTATTTGCCTATGAGAATGTTATCTAGACAGCAGTG
CACTCCCCTAAGTCTCTGCTCA
```

FIGURE 171

MAGSPTCLTLIYILWQLTGSAASGPVKELVGSVGGAVTFPLKSKVKQVDSIVWTFNTTPLVT
IQPEGGTIIVTQNRNRERVDFPDGGYSLKLSKLKKNDSGIYYVGIYSSSLQQPSTQEYVLHV
YEHLSKPKVTMGLQSNKNGTCVTNLTCCMEHGEEDVIYTWKALGQAANESHNGSILPISWRW
GESDMTFICVARNPVSRNFSSPILARKLCEGAADDPDSSMVLLCLLLVPLLLSLFVLGLFLW
FLKRERQEEYIEEKKRVDICRETPNICPHSGENTEYDTIPHTNRTILKEDPANTVYSTVEIP
KKMENPHSLLTMPDTPRLFAYENVI

FIGURE 172

CTGGTTCCCCAACATGCCTCACCCTCATCTATATCCTTTGGCAGCTCACAGGGTCAGCAGCC
TCTGGACCCGTGAAAGAGCTGGTCGGTTCCGTTGGTGGGGCCGTGACTTTCCCCCTGAAGTC
CAAAGTAAAGCAAGTTGACTCTATTGTCTGGACCTTCAACACAACCCCTCTTGTCACCATAC
AGCCAGAAGGGGGCACTATCATAGTGACCCAAAATCGTAATAGGGAGAGAGTAGACTTCCCA
GATGGAGGCTACTCCCTGAAGCTCAGCAAACTGAAGAAGAATGACTCAGGGATCTACTATGT
GGGGATATACAGCTCATCACTCCAGCAGCCCTCCACCCAGGAGTACGTGCTGCATGTCTACG
AGCACCTGTCAAAGCCTAAAGTCACCATGGGTCTGCAGAGCAATAAGAATGGCACCTGTGTG
ACCAATCTGACATGCTGCATGGAACATGGGGAAGAGGATGTGATTTATACCTGGAAGGCCCT
GGGGCAAGCAGCCAATGAGTCCCATAATGGGTCCATCCTCCCCATCTCCTGGAGATGGGGAG
AAAGTGATATGACCTTCATCTGCGTTGCCAGGAACCCTGTCAGCAGAAACTTCTCAAGCCCC
ATCCTTGCCAGGAAGCTCTGTGAAGGTGCTGCTGATGACCCAGATTCCTCCATGGTCCTCCT
GTGTCTCCTGTTGGTGCCCCTCCTGCTCAGTCTCTTTGTACTGGGGCTATTTCTTTGGTTTC
TGAAGAGAGAGAGACAAGAAGAGTACATTGAAGAAGAAGAGAGTGGACATTGTCGGGAA
ACTCCTAACATATGCCCCATTCTGGAGAGAACACAGAGTACGACACAATCCCTCACACTAA
TAGAACAATCCTAAAGGAAGATCCAGCAAATACGGTTTACTCCACTGTGGAAATACCGAAAA
AGATGGAAAATCCCCACTCACTGCTCACGATGCCAGACACACCAAGGCTATTTGCCTATGAG
AATGTTATCTAGACAGCAGTGCACTCCCCTAAGTCTCTGCTCAAAAAAAAAAAAAAAAAAA

FIGURE 173

GAAAGACGTGGTCCTGACAGACAGACAATCCTATTCCCTACCAAAATGAAGATGCTGCTGCT
GCTGTGTTTGGGACTGACCCTAGTCTGTGTCCATGCAGAAGAAGCTAGTTCTACGGGAAGGA
ACTTTAATGTAGAAAGATTAATGGGGAATGGCATACTATTATCCTGGCCTCTGACAAAAGA
GAAAGATAGAAGAACATGGCAACTTTAGACTTTTTCTGGAGCAAATCCATGTCTTGGAGAA
TTCCTTAGTTCTTAAAGTCCATACTGTAAGAGATGAAGAGTGCTCCGAATTATCTATGGTTG
CTGACAAAACAGAAAAGGCTGGTGAATATTCTGTGACGTATGATGGATTCAATACATTTACT
ATACCTAAGACAGACTATGATAACTTTCTTATGGCTCACCTCATTAACGAAAAGGATGGGGA
AACCTTCCAGCTGATGGGGCTCTATGGCCGAGAACCAGATTTGAGTTCAGACATCAAGGAAA
GGTTTGCACAACTATGTGAGGAGCATGGAATCCTTAGAGAAAATATCATTGACCTATCCAAT
GCCAATCGCTGCCTCCAGGCCCGAGAATGAAGAATGGCCTGAGCCTCCAGTGTTGAGTGGAC
ACTTCTCACCAGGACTCCACCATCATCCCTTCCTATCCATACAGCATCCCCAGTATAAATTC
TGTGATCTGCATTCCATCCTGTCTCACTGAGAAGTCCAATTCCAGTCTATCAACATGTTACC
TAGGATACCTCATCAAGAATCAAAGACTTCTTTAAATTTCTCTTTGATACACCCTTGACAAT
TTTTCATGAAATTATTCCTCTTCCTGTTCAATAAATGATTACCCTTGCACTTAA

FIGURE 174

MKMLLLLCLGLTLVCVHAEEASSTGRNFNVEKINGEWHTIILASDKREKIEEHGNFRLFLEQ
IHVLENSLVLKVHTVRDEECSELSMVADKTEKAGEYSVTYDGFNTFTIPKTDYDNFLMAHLI
NEKDGETFQLMGLYGREPDLSSDIKERFAQLCEEHGILRENIIDLSNANRCLQARE

FIGURE 175

GGCTCGAGCGTTTCTGAGCCAGGGGTGACCATGACCTGCTGCGAAGGATGGACATCCTGCAA
TGGATTCAGCCTGCTGGTTCTACTGCTGTTAGGAGTAGTTCTCAATGCGATACCTCTAATTG
TCAGCTTAGTTGAGGAAGACCAATTTTCTCAAAACCCCATCTCTTGCTTTGAGTGGTGGTTC
CCAGGAATTATAGGAGCAGGTCTGATGGCCATTCCAGCAACAACAATGTCCTTGACAGCAAG
AAAAAGAGCGTGCTGCAACAACAGAACTGGAATGTTTCTTTCATCATTTTTCAGTGTGATCA
CAGTCATTGGTGCTCTGTATTGCATGCTGATATCCATCCAGGCTCTCTTAAAAGGTCCTCTC
ATGTGTAATTCTCCAAGCAACAGTAATGCCAATTGTGAATTTTCATTGAAAAACATCAGTGA
CATTCATCCAGAATCCTTCAACTTGCAGTGGTTTTTCAATGACTCTTGTGCACCTCCTACTG
GTTTCAATAAACCCACCAGTAACGACACCATGGCGAGTGGCTGGAGAGCATCTAGTTTCCAC
TTCGATTCTGAAGAAACAAACATAGGCTTATCCACTTCTCAGTATTTTAGGTCTATTGCT
TGTTGGAATTCTGGAGGTCCTGTTTGGGCTCAGTCAGATAGTCATCGGTTTCCTTGGCTGTC
TGTGTGGAGTCTCTAAGCGAAGAAGTCAAATTGTGTAGTTTAATGGGAATAAAATGTAAGTA
TCAGTAGTTTGAAAAAAAAAAA

FIGURE 176

```
MTCCEGWTSCNGFSLLVLLLLGVVLNAIPLIVSLVEEDQFSQNPISCFEWWFPGIIGAGLMA
IPATTMSLTARKRACCNNRTGMFLSSFFSVITVIGALYCMLISIQALLKGPLMCNSPSNSNA
NCEFSLKNISDIHPESFNLQWFFNDSCAPPTGFNKPTSNDTMASGWRASSFHFDSEENKHRL
IHFSVFLGLLLVGILEVLFGLSQIVIGFLGCLCGVSKRRSQIV
```

FIGURE 177

GTCGAATCCAAATCACTCATTGTGAAAGCTGAGCTCACAGCCGAATAAGCCACATGAGGCT
GTCAGTGTGTCTCCTGATGGTCTCGCTGGCCCTTTGCTGCTACCAGGCCCATGCTCTTGTCT
GCCCAGCTGTTGCTTCTGAGATCACAGTCTTCTTATTCTTAAGTGACGCTGCGGTAAACCTC
CAAGTTGCCAAACTTAATCCACCTCCAGAAGCTCTTGCAGCCAAGTTGGAAGTGAAGCACTG
CACCGATCAGATATCTTTTAAGAAACGACTCTCATTGAAAAGTCCTGGTGGAAATAGTGAA
AAAATGTGGTGTGTGACATGTAAAAATGCTCAACCTGGTTTCCAAAGTCTTTCAACGACACC
CTGATCTTCACTAAAAATTGTAAAGGTTTCAACACGTTGCTTTAATAAATCACTTGCCCTGC

FIGURE 178

MRLSVCLLMVSLALCCYQAHALVCPAVASEITVFLFLSDAAVNLQVAKLNPPPEALAAKLEV
KHCTDQISFKKRLSLKKSWWK

FIGURE 179

ATCCGTTCTCTGCGCTGCCAGCTCAGGTGAGCCCTCGCCAAGGTGACCTCGCAGGACACTGG
TGAAGGAGCAGTGAGGAACCTGCAGAGTCACACAGTTGCTGACCAATTGAGCTGTGAGCCTG
GAGCAGATCCGTGGGCTGCAGACCCCCGCCCCAGTGCCTCTCCCCCTGCAGCCCTGCCCCTC
GAACTGTGACATGGAGAGAGTGACCCTGGCCCTTCTCCTACTGGCAGGCCTGACTGCCTTGG
AAGCCAATGACCCATTTGCCAATAAAGACGATCCCTTCTACTATGACTGGAAAAACCTGCAG
CTGAGCGGACTGATCTGCGGAGGGCTCCTGGCCATTGCTGGGATCGCGGCAGTTCTGAGTGG
CAAATGCAAATACAAGAGCAGCCAGAAGCAGCACAGTCCTGTACCTGAGAAGGCCATCCCAC
TCATCACTCCAGGCTCTGCCACTACTTGCTGAGCACAGGACTGGCCTCCAGGGATGGCCTGA
AGCCTAACACTGGCCCCAGCACCTCCTCCCTGGGAGGCCTTATCCTCAAGGAAGGACTTC
TCTCCAAGGGCAGGCTGTTAGGCCCCTTTCTGATCAGGAGGCTTCTTTATGAATTAAACTCG
CCCCACCACCCCCTCA

FIGURE 180

MERVTLALLLLAGLTALEANDPFANKDDPFYYDWKNLQLSGLICGGLLAIAGIAAVLSGKCK
YKSSQKQHSPVPEKAIPLITPGSATTC

FIGURE 181

```
GGAGAAGAGGTTGTGTGGGACAAGCTGCTCCCGACAGAAGGATGTCGCTGCTGAGCCTGCCC
TGGCTGGGCCTCAGACCGGTGGCAATGTCCCCATGGCTACTCCTGCTGCTGGTTGTGGGCTC
CTGGCTACTCGCCCGCATCCTGGCTTGGACCTATGCCTTCTATAACAACTGCCGCCGGCTCC
AGTGTTTCCCACAGCCCCCAAAACGGAACTGGTTTTGGGGTCACCTGGGCCTGATCACTCCT
ACAGAGGAGGGCTTGAAGGACTCGACCCAGATGTCGGCCACCTATTCCCAGGGCTTTACGGT
ATGGCTGGGTCCCATCATCCCCTTCATCGTTTTATGCCACCCTGACACCATCCGGTCTATCA
CCAATGCCTCAGCTGCCATTGCACCCAAGGATAATCTCTTCATCAGGTTCCTGAAGCCCTGG
CTGGGAGAAGGGATACTGCTGAGTGGCGGTGACAAGTGGAGCCGCCACCGTCGGATGCTGAC
GCCCGCCTTCCATTTCAACATCCTGAAGTCCTATATAACGATCTTCAACAAGAGTGCAAACA
TCATGCTTGACAAGTGGCAGCACCTGGCCTCAGAGGGCAGCAGTCGTCTGGACATGTTTGAG
CACATCAGCCTCATGACCTTGGACAGTCTACAGAAATGCATCTTCAGCTTTGACAGCCATTG
TCAGGAGAGGCCCAGTGAATATATTGCCACCATCTTGGAGCTCAGTGCCCTTGTAGAGAAAA
GAAGCCAGCATATCCTCCAGCACATGGACTTTCTGTATTACCTCTCCCATGACGGGCGGCGC
TTCCACAGGGCCTGCCGCCTGGTGCATGACTTCACAGACGCTGTCATCCGGGAGCGGCGTCG
CACCCTCCCCACTCAGGGTATTGATGATTTTTTCAAAGACAAAGCCAAGTCCAAGACTTTGG
ATTTCATTGATGTGCTTCTGCTGAGCAAGGATGAAGATGGGAAGGCATTGTCAGATGAGGAT
ATAAGAGCAGAGGCTGACACCTTCATGTTTGGAGGCCATGACACCACGGCCAGTGGCCTCTC
CTGGGTCCTGTACAACCTTGCGAGGCACCCAGAATACCAGGAGCGCTGCCGACAGGAGGTGC
AAGAGCTTCTGAAGGACCGCGATCCTAAAGAGATTGAATGGGACGACCTGGCCCAGCTGCCC
TTCCTGACCATGTGCGTGAAGGAGAGCCTGAGGTTACATCCCCAGCTCCCTTCATCTCCCG
ATGCTGCACCCAGGACATTGTTCTCCCAGATGGCCGAGTCATCCCCAAAGGCATTACCTGCC
TCATCGATATTATAGGGGTCCATCACAACCCAACTGTGTGGCCGGATCCTGAGGTCTACGAC
CCCTTCCGCTTTGACCCAGAGAACAGCAAGGGGAGGTCACCTCTGGCTTTTATTCCTTTCTC
CGCAGGGCCCAGGAACTGCATCGGGCAGGCGTTCGCCATGGCGGAGATGAAAGTGGTCCTGG
CGTTGATGCTGCTGCACTTCCGGTTCCTGCCAGACCACACTGAGCCCCGCAGGAAGCTGGAA
TTGATCATGCGCGCCGAGGGCGGGCTTTGGCTGCGGGTGGAGCCCCTGAATGTAGGCTTGCA
GTGACTTTCTGACCCATCCACCTGTTTTTTGCAGATTGTCATGAATAAAACGGTGCTGTCAAA
```

FIGURE 182

MSLLSLPWLGLRPVAMSPWLLLLLVVGSWLLARILAWTYAFYNNCRRLQCFPQPPKRNWFWG
HLGLITPTEEGLKDSTQMSATYSQGFTVWLGPIIPFIVLCHPDTIRSITNASAAIAPKDNLF
IRFLKPWLGEGILLSGGDKWSRHRRMLTPAFHFNILKSYITIFNKSANIMLDKWQHLASEGS
SRLDMFEHISLMTLDSLQKCIFSFDSHCQERPSEYIATILELSALVEKRSQHILQHMDFLYY
LSHDGRRFHRACRLVHDFTDAVIRERRRTLPTQGIDDFFKDKAKSKTLDFIDVLLLSKDEDG
KALSDEDIRAEADTFMFGGHDTTASGLSWVLYNLARHPEYQERCRQEVQELLKDRDPKEIEW
DDLAQLPFLTMCVKESLRLHPPAPFISRCCTQDIVLPDGRVIPKGITCLIDIIGVHHNPTVW
PDPEVYDPFRFDPENSKGRSPLAFIPFSAGPRNCIGQAFAMAEMKVVLALMLLHFRFLPDHT
EPRRKLELIMRAEGGLWLRVEPLNVGLQ

FIGURE 183

CAACAGAAGCCAAGAAGGAAGCCGTCTATCTTGTGGCGATCATGTATAAGCTGGCCTCCTGC
TGTTTGCTTTTCACAGGATTCTTAAATCCTCTCTTATCTCTTCCTCTCCTTGACTCCAGGGA
AATATCCTTTCAACTCTCAGCACCTCATGAAGACGCGCGCTTAACTCCGGAGGAGCTAGAAA
GAGCTTCCCTTCTACAGATATTGCCAGAGATGCTGGGTGCAGAAAGAGGGGATATTCTCAGG
AAAGCAGACTCAAGTACCAACATTTTTAACCCAAGAGGAAATTTGAGAAAGTTTCAGGATTT
CTCTGGACAAGATCCTAACATTTTACTGAGTCATCTTTTGGCCAGAATCTGGAAACCATACA
AGAAACGTGAGACTCCTGATTGCTTCTGGAAATACTGTGTCTGAAGTGAAATAAGCATCTGT
TAGTCAGCTCAGAAACACCCATCTTAGAATATGAAAAATAACACAATGCTTGATTTGAAAAC
AGTGTGGAGAAAAACTAGGCAAACTACACCCTGTTCATTGTTACCTGGAAAATAAATCCTCT
ATGTTTTGCACAAAAAAAAAAAAAAA

FIGURE 184

MYKLASCCLLFTGFLNPLLSLPLLDSREISFQLSAPHEDARLTPEELERASLLQILPEMLGA
ERGDILRKADSSTNIFNPRGNLRKFQDFSGQDPNILLSHLLARIWKPYKKRETPDCFWKYCV

FIGURE 185

GAACATTTTTAGTTCCCAAGGAATGTACATCAGCCCCACGGAAGCTAGGCCACCTCTGGGAT
GGGGTTGCTGGTTTAAAACAAACGCCAGTCATCCTATATAAGGACCTGACAGCCACCAGGCA
CCACCTCCGCCAGGAACTGCAGGCCCACCTGTCTGCAACCCAGCTGAGGCCATGCCCTCCCC
AGGGACCGTCTGCAGCCTCCTGCTCCTCGGCATGCTCTGGCTGGACTTGGCCATGGCAGGCT
CCAGCTTCCTGAGCCCTGAACACCAGAGAGTCCAGCAGAGAAGGAGTCGAAGAAGCCACCA
GCCAAGCTGCAGCCCCGAGCTCTAGCAGGCTGGCTCCGCCCGGAAGATGGAGGTCAAGCAGA
AGGGGCAGAGGATGAACTGGAAGTCCGGTTCAACGCCCCCTTTGATGTTGGAATCAAGCTGT
CAGGGGTTCAGTACCAGCAGCACAGCCAGGCCCTGGGGAAGTTTCTTCAGGACATCCTCTGG
GAAGAGGCCAAAGAGGCCCCAGCCGACAAGTGATCGCCCACAAGCCTTACTCACCTCTCTCT
AAGTTTAGAAGCGCTCATCTGGCTTTTCGCTTGCTTCTGCAGCAACTCCCACGACTGTTGTA
CAAGCTCAGGAGGCGAATAAATGTTCAAACTGTA

FIGURE 186

MPSPGTVCSLLLLGMLWLDLAMAGSSFLSPEHQRVQQRKESKKPPAKLQPRALAGWLRPEDG
GQAEGAEDELEVRFNAPFDVGIKLSGVQYQQHSQALGKFLQDILWEEAKEAPADKO

FIGURE 187

```
CGGCCACAGCTGGCATGCTCTGCCTGATCGCCATCCTGCTGTATGTCCTCGTCCAGTACCTC
GTGAACCCCGGGGTGCTCCGCACGGACCCCAGATGTCAAGAATATGAACACGTGGCTGCTGT
TCCTCCCCCTGTTCCCGGTGCAGGTGCAGACCCTGATAGTCGTGATCATCGGGATGCTCGTG
CTCCTGCTGGACTTTCTTGGCTTGGTGCACCTGGGCCAGCTGCTCATCTTCCACATCTACCT
GAGTATGTCCCCCACCCTAAGCCCCCGATCCCCCAAGGCTGGGTGGTCAGAGCTGCTCATC
TTACACCTCTACTTGAGTATGTCCCTAACCCTGAGCCCCCCACGCCTGGGGCCAGAGTCTTT
GTCCCCCGTGTGCGCATGTGTTCAGGGTCAGCCTCTCCCAGAAGTGAGATCATGGACAAAAA
GGGCAAATCACAGGAAGAAATTAAATCCATGAGGACCCAGCAGGCCCAGCAAGAAGCTGAAC
TCACGCCGAGACCTGCAGGAGTGGTGCCAGGTGCTTGAAGTAACAAGTTTAAAATGTTCAGA
GACAATGGAATGGAATCTATTAGGCAAGAACAGGACATTATGAAATAAGGACAGGTGGACTT
CCAAAAACACAAGTAGAAATTCTAACAATGAAATATATTACAGGCAGGTCACCCACTAACCA
AACAACTGAAGCGAGAGCTGTGGTCTTGCTTGGTCTCACAGTGGGCACAGCGGTAGGCGGTC
AGTCATGTTGCTGAACGACGGAGGGTAAACTCCCCAGCCCCAAGAAAACCTGTGTTGGAAGT
AACAACAACCTCCCTGCTCCTGGCACCAGCCGTTTTGGTCATGGTGGGCCAGCTGCAAAGCG
TCTTCCATTCTCTGGGCAGTGGTGGCCCCGAGGCTGTGGCCTCTCAGGGGGTTTCTGTGGAC
ACGGGCAGCAGAGTGTGTCCAGGCCAGCCCCCAAGAATGCCCTGCTCCTGACAGCTTGGCCA
ACCCCTGGTCAGGGCAGAGGGAGTTGGGTGGGTCAGGCTCTGGGCTCACCTCCATCTCCAGA
GCATCCCCTGCCTGCAGTTGTGGCAAGAACGCCCAGCTCAGAATGAACACACCCCACCAAGA
GCCTCCTTGTTCATAACCACAGGTTACCCTACAAACCACTGTCCCACACAACCCTGGGGAT
GTTTTAAAACACACACCTCTAACGCATATCTTACAGTCACTGTTGTCTTGCCTGAGGGTTGA
ATTTTTTTTAATGAAAGTGCAATGAAAATCACTGGATTAAATCCTACGGACACAGAGCTGAA
AAAAAAAAAAAAAAAAAAAAAAAAAAAA
```

FIGURE 188

MNTWLLFLPLFPVQVQTLIVVIIGMLVLLLDFLGLVHLGQLLIFHIYLSMSPTLSPRSPQGW
VVRAAHLTPLLEYVPNPEPPTPGARVFVPRVRMCSGSASPRSEIMDKKGKSQEEIKSMRTQQ
AQQEAELTPRPAGVVPGA

FIGURE 189

GGAGTGCAGATGGCATCCTTCGGTTCTTCCAGACAAGCTGCAAGACGCTGACCATGGCCAAG
ATGGAGCTCTCGAAGGCCTTCTCTGGCCAGCGGACACTCCTATCTGCCATCCTCAGCATGCT
ATCACTCAGCTTCTCCACAACATCCCTGCTCAGCAACTACTGGTTTGTGGGCACACAGAAGG
TGCCCAAGCCCCTGTGCGAGAAAGGTCTGGCAGCCAAGTGCTTTGACATGCCAGTGTCCCTG
GATGGAGATACCAACACATCCACCCAGGAGGTGGTACAATACAACTGGGAGACTGGGGATGA
CCGGTTCTCCTTCCGGAGCTTCCGGAGTGGCATGTGGCTATCCTGTGAGGAAACTGTGGAAG
AACCAGGGGAGAGGTGCCGAAGTTTCATTGAACTTACACCACCAGCCAAGAGAGGTGAGAAA
GGACTACTGGAATTTGCCACGTTGCAAGGCCCATGTCACCCCACTCTCCGATTTGGAGGGAA
GCGGTTGATGGAGAAGGCTTCCCTCCCCTCCCCTCCCTTGGGGCTTTGTGGCAAAAATCCTA
TGGTTATCCCTGGGAACGCAGATCACCTACATCGGACTTCAATTCATCAGCTTCCTCCTGCT
ACTAACAGACTTGCTACTCACTGGGAACCCTGCCTGTGGGCTCAAACTGAGCGCCTTTGCTG
CTGTTTCCTCTGTCCTGTCAGGTCTCCTGGGGATGGTGGCCCACATGATGTATTCACAAGTC
TTCCAAGCGACTGTCAACTTGGGTCCAGAAGACTGGAGACCACATGTTTGGAATTATGGCTG
GGCCTTCTACATGGCCTGGCTCTCCTTCACCTGCTGCATGGCGTCGGCTGTCACCACCTTCA
ACACGTACACCAGGATGGTGCTGGAGTTCAAGTGCAAGCATAGTAAGAGCTTCAAGGAAAAC
CCGAACTGCCTACCACATCACCATCAGTGTTTCCCTCGGCGGCTGTCAAGTGCAGCCCCCAC
CGTGGGTCCTTTGACCAGCTACCACCAGTATCATAATCAGCCCATCCACTCTGTCTCTGAGG
GAGTCGACTTCTACTCCGAGCTGCGGAACAAGGGATTTCAAAGAGGGGCCAGCCAGGAGCTG
AAAGAAGCAGTTAGGTCATCTGTAGAGGAAGAGCAGTGTTAGGAGTTAAGCGGGTTTGGGGA
GTAGGCTTGAGCCCTACCTTACACGTCTGCTGATTATCAACATGTGCTTAAGCCAACATCCG
TCTCTTGAGCATGGTTTTTAGAGGCTACGAATAAGGCTATGAATAAGGGTTATCTTTAAGTC
CTAAGGGATTCCTGGGTGCCACTGCTCTCTTTTCCTCTACAGCTCCATCTTGTTTCACCCAC
CCCACATCTCACACATCCAGAATTCCCTTCTTTACTGATAGTTTCTGTGCCAGGTTCTGGGC
TAAACCATGGAGATAAAAGAAGAGTAAATACACTTCCCGACCTTAAGGATCTGAAA

FIGURE 190

MAKMELSKAFSGQRTLLSAILSMLSLSFSTTSLLSNYWFVGTQKVPKPLCEKGLAAKCFDMP
VSLDGDTNTSTQEVVQYNWETGDDRFSFRSFRSGMWLSCEETVEEPGERCRSFIELTPPAKR
GEKGLLEFATLQGPCHPTLRFGGKRLMEKASLPSPPLGLCGKNPMVIPGNADHLHRTSIHQL
PPATNRLATHWEPCLWAQTERLCCCFLCPVRSPGDGGPHDVFTSLPSDCQLGSRRLETTCLE
LWLGLLHGLALLHLLHGVGCHHLQHVHQDGAGVQVQA

FIGURE 191

```
AACTGGAAGGAAAGAAAGAAAGGTCAGCTTTGGCCCAGATGTGGTTACCCCTTGGTCTCCTG
TCTTTATGTCTTTCTCCTCTTCCTATTCTGTCATCTCCCTCACTTAAGTCTCAGGCCTGTCA
GCAGCTCCTGTGGACATTGCCATCCCCTCTGGTAGCCTTCAGAGCAAACAGGACAACCTATG
TTATGGATGTTTCCACCAACCAGGGTAGTGGCATGGAGCACCGTAACCATCTGTGCTTCTGT
GATCTCTATGACAGAGCCACTTCTCCACCTCTGAAATGTTCCCTGCTCTGAAATCTGGCATG
AGATGGCACAGGTGACCACGCAGAAGCCACCAGAATCTTGCCTGCCCTATTCCTCCTCCCAA
GTCTGTTCTCTTATTGTCAACCTCAGCACAACAGGCTGGCGCCAATGGCATTACAGAGAAAG
CAATCTGTGTGGCTAGTGGGCAGATTACCATGCAAGCCCCAGGAGAAATGGAGGAGCTTTGT
AGCCACCTCCCTGTCAGCCAGTATTAACATGTCCCCTTCCCCCTGCCCCGCCGTAGATTCAG
GACATTCGCCCTGTGTGCCACCAAACCAGGACTTTCCCCTTGGCTTGGCATCCCTGGCTCT
CTCCTGGTACCCAGCAAGACGTCTGTTCCAGGGCAGTGTAGCATCTTTCAAGCTCCGTTACT
ATGGCGATGGCCATGATGTTACAATCCCACTTGCCTGAATAATCAAGTGGGAAGGGGAAGCA
GAGGGAAATGGGGCCATGTGAATGCAGCTGCTCTGTTCTCCCTACCCTGAGGAAAAACCAAA
GGGAAGCAACAGGAACTTCTGCAACTGGTTTTTATCGGAAGATCATCCTGCCTGCAGATGC
TGTTGAAGGGGCACAAGAAATGTAGCTGGAGAAGATTGATGAAAGTGCAGGTGTGTAAGGAA
ATAGAACAGTCTGCTGGGAGTCAGACCTGGAATTCTGATTCCAAACTCTTTATTACTTTGGG
AAGTCACTCAGCCTCCCCGTAGCCATCTCCAGGGTGACGGAACCCAGTGTATTACCTGCTGG
AACCAAGGAAACTAACAATGTAGGTTACTAGTGAATACCCCAATGGTTTCTCCAATTATGCC
CATGCCACCAAAACAATAAACAAAATTCTCTAACACTGAAA
```

FIGURE 192

MWLPLGLLSLCLSPLPILSSPSLKSQACQQLLWTLPSPLVAFRANRTTYVMDVSTNQGSGME
HRNHLCFCDLYDRATSPPLKCSLL

FIGURE 193

```
GTAGCGCGTCTTGGGTCTCCCGGCTGCCGCTGCTGCCGCCGCCGCCTCGGGTCGTGGAGCCAGGAGCGACGTCA
CCGCCATGGCAGGCATCAAAGCTTTGATTAGTTTGTCCTTTGGAGGAGCAATCGGACTGATGTTTTTGATGCTT
GGATGTGCCCTTCCAATATACAACAAATACTGGCCCCTCTTTGTTCTATTTTTTTACATCCTTTCACCTATTCC
ATACTGCATAGCAAGAAGATTAGTGGATGATACAGATGCTATGAGTAACGCTTGTAAGGAACTTGCCATCTTTC
TTACAACGGGCATTGTCGTGTCAGCTTTTGGACTCCCTATTGTATTTGCCAGAGCACATCTGATTGAGTGGGGA
GCTTGTGCACTTGTTCTCACAGGAAACACAGTCATCTTTGCAACTATACTAGGCTTTTTCTTGGTCTTTGGAAG
CAATGACGACTTCAGCTGGCAGCAGTGGTGAAAAGAAATTACTGAACTATTGTCAAATGGACTTCCTGTCATTT
GTTGGCCATTCACGCACACAGGAGATGGGGCAGTTAATGCTGAATGGTATAGCAAGCCTCTTGGGGGTATTTTA
GGTGCTCCCTTCTCACTTTTATTGTAAGCATACTATTTTCACAGAGACTTGCTGAAGGATTAAAAGCATTTTCT
CTTTTGGAAAAGCTTGACTGATTTCACACTTATCTATAGTATGCTTTTGTGGTGTCCTGCTGAATTTAAATAT
TTATGTGTTTTTCCTGTTAGGTTGATTTTTTTGGAATCAATATGCAATGTTAAACACTTTTTTAATGTAATCA
TTTGCATTGGTTAGGAATTCAGAATTCCGCCGGCTCTATTACTGGTCAAGTACATCTTTTCTCTTAAAATTATT
TAGCCTCCATTATTACAAAAAATTATAAAAATAAGTTTTCAGTCAGTCAGGATGACATCACTCCCAATGTTATG
CAGACATACAGACGGTTGGCATACGTTATAGACTGTATACTCAGTGCAAATATAGCTGCATTTATACCTCAGAG
GGGCCAAGTGTTAATGCCCATGCCCTCCGTTAAGGGTTGTTGGTTTTACTGGTAGACAGATGTTTTGTGGATTG
AAAATTATTTTATGGAATTGCTACAGAGGAGTGCTTTTCTTCTCAATTGTTAGAAGAATTTATGTTAAACTTTA
AGGTAAGGGTGTAAAAACATTTTTGAGATAAGGTTTTTATTTATGTTTATTATTGTTAGAGTGAGTTGCAATGT
GGGAAGAAATGACATTGAAATTCCAGTTTTTGAATCCTGTTTCTATTTATAAGTGAAATTTGTGATCTCCTATC
AACCTTTCATGTTTTACCCTGTTAAAATGGACATACATGGAACCACTACTGATGAGGGACAGTTGTATGTTTGC
ATCATATATGCCAGAAAACCTTCCTCTGCTTCCTCCTTTTGACTTATTTGGTATGTTGTATATATTACATAAAA
TAACTTTTCAAATATAGTTTAATAACACTTAGAAGTGTTTACTTACCTGGAAAATAATTGCTATGCCGTACATT
CAGAGTGCCCCCTCCCCTGCAAGGCCTTGCCATGATTAACAAGTAACTTGTTAGTCTTACAGATAATTCATGCA
TTAACAGTTTAAGATTTAGACCATGGTAATAGTAGTTCTTATTCTCTAAGGTTATATCATATGTAATTTAAAAG
TATTTTTAAGACAAGTTCCTGTATACCTCTGAACTGTTTTGATTTTGAGTTCATCATGATAGATCTGCTGTTT
CCTTATAAAAGGCATTTGTTGTGTGAGTTAATGCAAAGTAGCCAAGTCCAGCTATATAGCAGCTTCAGAAACAT
ACCTGACCAAAAAATTCCCAGTAACCAGGCATGATCAATTTATAGTGGTCGTTTACATCTAATAATTATCAGGA
CTTTTTTCAGGAGTGGGTTATAAAAACATTCAAGTTGGTCTGACAGTATTTTGTTAAGGATATTTGTTTGTATG
TTTATTCAGTATACTTACATAAAAATTATTTCGCCATCAGCCAAAACTCAGTAATCATGACAGCTGTCTGTTGT
TTTATGAAGTTTATTTCTCAAGAAAATGGGAATAAATTTGGGATTTGTTCAGCTTTTTTACTAAAGATGCCTAA
AGCCACAGGTTTTATTGCCTAACTTAAGCCATGACTTTTAGATATGAGATGACGGGAAGCAGGACGAAATATCG
GCGTGTGGCTGGAGCCTTCCCACTGGAGGCTGAAAGTGCCTTGTGGTATTATAATGTTCAGATTTCAAGAGGAA
GGTGCAGGTACACATGAGTTAGAGAGCTGGTGAGACAGTTGGGAACTCTTTGTGCTTGTGATCTACTGGACTTT
TTTTTTGCAGGAAGTGCATTCTCTGGTCCTTCCCTATTTTCTGTTCTGGATGTCAGTGCAGTGCACTGCTACTG
TTTTATCCACTTGGCCACAGACTTTTTCTAACAGCTGCGTATTATTTCTATATACTAATTGCATTGGCAGCATT
GTGTCTTTGACCTTGTATACTAGCTTGACATAGTGCTGTCTCTGATTTCTAGGCTAGTTACTTGAGATATGAAT
TTCCATAGAATATGCACTGATACAACATTACCATTCTTCTATGGAAAGAAAACTTTTGATGATGAAACAATAA
AGATTTTAAATATCTATTTTAAAAAAAAA
```

FIGURE 194

MAGIKALISLSFGGAIGLMFLMLGCALPIYNKYWPLFVLFFYILSPIPYCIARRLVDDTDAM
SNACKELAIFLTTGIVVSAFGLPIVFARAHLIEWGACALVLTGNTVIFATILGFFLVFGSND
DFSWQQW

FIGURE 195

```
CCCACGCGTCCGCCCACGCGTCCGCCCACGCGTCCGCCCACGCGTCCGCCCACGCGTCCGCCCACGCGTCCGCC
CACGCGTCCGGTGCAAGCTCGCGCCGCACACTGCCTGGTGGAGGGAAGGAGCCCGGGCGCCTCTCGCCGCTCCC
CGCGCCGCCGTCCGCACCTCCCCACCGCCCGCCGCCCGCCGCCCGCCGCCCGCAAAGCATGAGTGAGCCCGCTC
TCTGCAGCTGCCCGGGGCGCGAATGGCAGGCTGTTTCCGCGGAGTAAAAGGTGGCGCCGGTCAGTGGTCGTTTC
CAATGACGGACATTAACCAGACTGTCAGATCCTGGGGAGTCGCGAGCCCCGAGTTTGGAGTTTTTTCCCCCCAC
AACGTCACAGTCCGAACTGCAGAGGGAAAGGAAGGCGGCAGGAAGGCGAAGCTCGGGCTCCGGCACGTAGTTGG
GAAACTTGCGGGTCCTAGAAGTCGCCTCCCCGCCTTGCCGGCCGCCCTTGCAGCCCCGAGCCGAGCAGCAAAGT
GAGACATTGTGCGCCTGCCAGATCCGCCGGCCGCGGACCGGGGCTGCCTCGGAAACACAGAGGGGTCTTCTCTC
GCCCTGCATATAATTAGCCTGCACACAAAGGGAGCAGCTGAATGGAGGTTGTCACTCTCTGGAAAAGGATTTCT
GACCGAGCGCTTCCAATGGACATTCTCCAGTCTCTCTGGAAAGATTCTCGCTAATGGATTTCCTGCTGCTCGGT
CTCTGTCTATACTGGCTGCTGAGGAGGCCCTCGGGGGTGGTCTTGTGTCTGCTGGGGGCCTGCTTTCAGATGCT
GCCCGCCGCCCCCAGCGGGTGCCCGCAGCTGTGCCGGTGCGAGGGCGGCTGCTGTACTGCGAGGCGCTCAACC
TCACCGAGGCGCCCCACAACCTGTCCGGCCTGCTGGGCTTGTCCCTGCGCTACAACAGCCTCTCGGAGCTGCGC
GCCGGCCAGTTCACGGGGTTAATGCAGCTCACGTGGCTCTATCTGGATCACAATCACATCTGCTCCGTGCAGGG
GGACGCCTTTCAGAAACTGCGCCGAGTTAAGGAACTCACGCTGAGTTCCAACCAGATCACCCAACTGCCCAACA
CCACCTTCCGGCCCATGCCCAACCTGCGCAGCGTGGACCTCTCGTACAACAAGCTGCAGGCGCTCGCGCCCGAC
CTCTTCCACGGGCTGCGGAAGCTCACCACGCTGCATATGCGGGCCAACGCCATCCAGTTTGTGCCCGTGCGCAT
CTTCCAGGACTGCCGCAGCCTCAAGTTTCTCGACATCGGATACAATCAGCTCAAGAGTCTGGCGCGCAACTCTT
TCGCCGGCTTGTTTAAGCTCACCGAGCTGCACCTCGAGCACAACGACTTGGTCAAGGTGAACTTCGCCCACTTC
CCGCGCCTCATCTCCCTGCACTCGCTCTGCCTGCGGAGGAACAAGGTGGCCATTGTGGTCAGCTCGCTGGACTG
GGTTTGGAACCTGGAGAAAATGGACTTGTCGGGCAACGAGATCGAGTACATGGAGCCCCATGTGTTCGAGACCG
TGCCGCACCTGCAGTCCCTGCAGCTGGACTCCAACCGCCTCACCTACATCGAGCCCCGGATCCTCAACTCTTGG
AAGTCCCTGACAAGCATCACCCTGGCCGGGAACCTGTGGGATTGCGGGCGCAACGTGTGTGCCCTAGCCTCGTG
GCTCAGCAACTTCCAGGGGCGCTACGATGGCAACTTGCAGTGCGCCAGCCCGGAGTACGCACAGGGCGAGGACG
TCCTGGACGCCGTGTACGCCTTCCACCTGTGCGAGGATGGGGCCGAGCCCACCAGCGGCCACCTGCTCTCGGCC
GTCACCAACCGCAGTGATCTGGGGCCCCCTGCCAGCTCGGCCACCACGCTCGCGGACGGCGGGGAGGGGCAGCA
CGACGGCCACATTCGAGCCTGCCACCGTGGCTCTTCCAGGCGGCGAGCACGCCGAGAACGCCGTGCAGATCCACA
AGGTGGTCACGGGCACCATGGCCCTCATCTTCTCCTTCCTCATCGTGGTCCTGGTGCTCTACGTGTCCTGGAAG
TGTTTCCCAGCCAGCCTCAGGCAGCTCAGACAGTGCTTTGTCACGCAGCGCAGGAAGCAAAAGCAGAAACAGAC
CATGCATCAGATGGCTGCCATGTCTGCCCAGGAATACTACGTTGATTACAAACCGAACCACATTGAGGGAGCCC
TGGTGATCATCAACGAGTATGGCTCGTGTACCTGCCACCAGCAGCCCGCGAGGGAATGCGAGGTGATTGTCC
CAGTGGCTCTCAACCCATGCGCTACCAAATACGCCTGGGCAGCCGGGACGGGCCGGCGGGCACCAGGCTGGGGT
CTCCTTGTCTGTGCTCTGATATGCTCCTTGACTGAAACTTTAAGGGGATCTCTCCCAGAGACTTGACATTTTAG
CTTTATTGTGTCTTAAAAACAAAAGCGAATTAAAACACAACAAAAAACCCCACCCCACAACCTTCAGGACAGTC
TATCTTAAATTTCATATGAGAACTCCTTCCTCCCTTTGAAGATCTGTCCATATTCAGGAATCTGAGAGTGTAAA
AAAGGTGGCCATAAGACAGAGAGAGAATAATCGTGCTTTGTTTTATGCTACTCCTCCCACCCTGCCCATGATTA
AACATCATGTATGTAGAAGATCTTAAGTCCATACGCATTTCATGAAGAACCATTGGAAAGAGGAATCTGCAATC
TGGGAGCTTAAGAGCAAATGATGACCATAGAAAGCTATGTTCTTACTTTGTGTGTGTGTCTGTATGTTTCTGCG
TTGTGTGTCTTTGTAGGCAAGCAAACGTTGTCTACACAAACGGGAATTTAGCTCACATCATTTCATGCCCCTGT
GCCTCTAGCTCTGGAGATTGGTGGGGGGAGGTGGGGGGAAACGGCAGGAATAAGGGAAAGTGGTAGTTTTAACT
AAGGTTTTGTAACACTTGAAATCTTTTCTTTCTCAAATTAATTATCTTTAAGCTTCAAGAAACTTGCTCTGACC
CCTCTAAGCAAACTACTAAGCATTTAAAAGAGAATCTAATTTTTAAAGGTGTAGCACCTTTTTTTTTATTCTTC
CCACAGAGGGTGCTAATCTCATTATGCTGTGCTATCTGAAAAGAACTTAAGGCCACAATTCACGTCTCGTCCTG
GGCATTGTGATGGATTGACCCTCCATTTGCAGTACCTTCCCAGCTGATTAAAGTTCAGCAGTGGTATTGAGGTT
TTTCGAATATTTATATAGAAAAAAAGTCTTTTCACATGACAAATGACACTCTCACACCAGTCTTAGCCCTAGTA
GTTTTTTAGGTTGGACCAGAGGAAGCAGGTTAAATGAGACCTGTCCTCTGCTGCACTCAGAAAAAATAGGCAGT
CCCTGATGCTCAGATCTTAGCCTTGATATTAATAGTTGAGACCACCTACCCACAATGCAGCCTATACTCCCAAG
ACTACAAAGTTACCATCGCAAAGGAAAGGTTATTCCAGTAAAAGGAAATAGTTTTCTCAACCATTTAAAAATAT
TCTTCTGAACTCATCAAAGTAGAAGAGCCCCCAACCTTTTCTCTCTGCCTTCAAGAAGGCAGACATTTGGTATG
ATTTAGCATCAACAACACATTTATGAGTATATGTAAGTAATCAGAGGGGCAAATGCCACTTGTTATTCCTCCCA
AGTTTTCCAAGCAAGTACACACAGATCTCTGGTAGGATTAGGGGCCACTTGTGTTTCCGGCTTATTTTAGTCGA
CTTGTCAGCAAGTTTGATGCCTAGTCTATCTGACATGGCCCAGTAGAACAGGGCATTGATGGATCACATGAGAT
GGTAGAAGGAACATCATCACATACCCCTCTCACAGAGAAAATTATCAAAGAACCAGAAATTATATCTGTTTTGG
AGCAAGAGTGTCATAATGTTTCAGGGTAGTCAAAATAAACATAAATTATCTCCTCTAGATGAGTGGCGATGTTG
GCTGATTTGGGTCTGCCATTGACAGAATGTCAAATAAAAAGGAATTAGCTAGAATATGACCATTAAATGTGCTT
CTGAAATATATTTTGAGATAGGTTTAGAATGTCA
```

FIGURE 196

MDFLLLGLCLYWLLRRPSGVVLCLLGACFQMLPAAPSGCPQLCRCEGRLLYCEALNLTEAPH
NLSGLLGLSLRYNSLSELRAGQFTGLMQLTWLYLDHNHICSVQGDAFQKLRRVKELTLSSNQ
ITQLPNTTFRPMPNLRSVDLSYNKLQALAPDLFHGLRKLTTLHMRANAIQFVPVRIFQDCRS
LKFLDIGYNQLKSLARNSFAGLFKLTELHLEHNDLVKVNFAHFPRLISLHSLCLRRNKVAIV
VSSLDWVWNLEKMDLSGNEIEYMEPHVFETVPHLQSLQLDSNRLTYIEPRILNSWKSLTSIT
LAGNLWDCGRNVCALASWLSNFQGRYDGNLQCASPEYAQGEDVLDAVYAFHLCEDGAEPTSG
HLLSAVTNRSDLGPPASSATTLADGGEGQHDGTFEPATVALPGGEHAENAVQIHKVVTGTMA
LIFSFLIVVLVLYVSWKCFPASLRQLRQCFVTQRRKQKQKQTMHQMAAMSAQEYYVDYKPNH
IEGALVIINEYGSCTCHQQPARECEV

FIGURE 197

GTGCAAGGAGCCGAGGCGAGATGGGCGTCCTGGGCCGGGTCCTGCTGTGGCTGCAGCTCTGC
GCACTGACCCAGGCGGTCTCCAAACTCTGGGTCCCCAACACGGACTTCGACGTCGCAGCCAA
CTGGAGCCAGAACCGGACCCCGTGCGCCGGCGGCGCCGTTGAGTTCCCGGCGGACAAGATGG
TGTCAGTCCTGGTGCAAGAAGGTCACGCCGTCTCAGACATGCTCCTGCCGCTGGATGGGGAA
CTCGTCCTGGCTTCAGGAGCCGGATTCGGCGTCTCAGACGTGGGCTCGCACCTGGACTGTGG
CGCGGGCGAACCTGCCGTCTTCCGCGACTCTGACCGCTTCTCCTGGCATGACCCGCACCTGT
GGCGCTCTGGGGACGAGGCACCTGGCCTCTTCTTCGTGGACGCCGAGCGCGTGCCCTGCCGC
CACGACGACGTCTTCTTTCCGCCTAGTGCCTCCTTCCGCGTGGGGCTCGGCCCTGGCGCTAG
CCCCGTGCGTGTCCGCAGCATCTCGGCTCTGGGCCGGACGTTCACGCGCGACGAGGACCTGG
CTGTTTTCCTGGCGTCCCGCGCGGGCCGCCTACGCTTCCACGGGCCGGGCGCGCTGAGCGTG
GGCCCCGAGGACTGCGCGGACCCGTCGGGCTGCGTCTGCGGCAACGCGGAGGCGCAGCCGTG
GATCTGCGCGGCCCTGCTCCAGCCCCT

FIGURE 198

MGVLGRVLLWLQLCALTQAVSKLWVPNTDFDVAANWSQNRTPCAGGAVEFPADKMVSVLVQE
GHAVSDMLLPLDGELVLASGAGFGVSDVGSHLDCGAGEPAVFRDSDRFSWHDPHLWRSGDEA
PGLFFVDAERVPCRHDDVFFPPSASFRVGLGPGASPVRVRSISALGRTFTRDEDLAVFLASR
AGRLRFHGPGALSVGPEDCADPSGCVCGNAEAQPWICAALLQP

FIGURE 199

ATCGCATCAATTGGGAGTACCATCTTCCTCATGGGACCAGTGAAACAGCTGAAGCGAATGTT
TGAGCCTACTCGTTTGATTGCAACTATCATGGTGCTGTTGTGTTTTGCACTTACCCTGTGTT
CTGCCTTTTGGTGGCATAACAAGGGACTTGCACTTATCTTCTGCATTTTGCAGTCTTTGGCA
TTGACGTGGTACAGCCTTTCCTTCATACCATTTGCAAGGGATGCTGTGAAGAAGTGTTTTGC
CGTGTGTCTTGCATAATTCATGGCCAGTTTTATGAAGCTTTGGAAGGCACTATGGACAGAAG
CTGGTGGACAGTTTTGTAACTATCTTCGAAACCTCTGTCTTACAGACATGTGCCTTTTATCT
TGCAGCAATGTGTTGCTTGTGATTCGAACATTTGAGGGTTACTTTTGGAAGCAACAATACAT
TCTCGAACCTGAATGTCAGTAGCACAGGATGAGAAGTGGGTTCTGTATCTTGTGGAGTGGAA
TCTTCCTCATGTACCTGTTTCCTCTCTGGATGTTGTCCCACTGAATTCCCATGAATACAAAC
CTATTCAGCAACAGCAAAAAAAAAAAAAAAAAAAAAAAAAAAAAAAAAAAAAAAAAAAAAAA
AAAAAAAAAAAAAAAAAAAAAA

FIGURE 200

MGPVKQLKRMFEPTRLIATIMVLLCFALTLCSAFWWHNKGLALIFCILQSLALTWYSLSFIP
FARDAVKKCFAVCLA

FIGURE 201

```
TTGAGCGCAGGTGAGCTCCTGCGCGTTCCGGGGGCGTTCCTCCAGTCACCCTCCCGCCGTTACCCGCGGCGCGC
CCGAGGGAGTCTCCTCCAGACCCTCCCTCCCGTTGCTCCAAACTAATACGGACTGAACGGATCGCTGCGAGGGT
GGGAGAGAAAATTAGGGGGAGAAAGGACAGAGAGAGCAACTACCATCCATAGCCAGATAGATTATCTTACACTG
AACTGATCAAGTACTTTGAAAATGACTTCGAAATTTATCTTGGTGTCCTTCATACTTGCTGCACTGAGTCTTTC
AACCACCTTTTCTCTCCAACTAGACCAGCAAAAGGTTCTACTAGTTTCTTTTGATGGATTCCGTTGGGATTACT
TATATAAAGTTCCAACGCCCCATTTTCATTATATTATGAAATATGGTGTTCACGTGAAGCAAGTTACTAATGTT
TTTATTACAAAAACCTACCCTAACCATTATACTTTGGTAACTGGCCTCTTTGCAGAGAATCATGGGATTGTTGC
AAATGATATGTTTGATCCTATTCGGAACAAATCTTTCTCCTTGGATCACATGAATATTTATGATTCCAAGTTTT
GGGAAGAAGCGACACCAATATGGATCACAAACCAGAGGGCAGGACATACTAGTGGTGCAGCCATGTGGCCCGGA
ACAGATGTAAAAATACATAAGCGCTTTCCTACTCATTACATGCCTTACAATGAGTCAGTTTCATTTGAAGATAG
AGTTGCCAAAATTGTTGAATGGTTTACGTCAAAAGAGCCCATAAATCTTGGTCTTCTCTATTGGGAAGACCCTG
ATGACATGGGCCACCATTTGGGACCTGACAGTCCGCTCATGGGGCCTGTCATTTCAGATATTGACAAGAAGTTA
GGATATCTCATACAAATGCTGAAAAAGGCAAAGTTGTGGAACACTCTGAACCTAATCATCACAAGTGATCATGG
AATGACGCAGTGCTCTGAGGAAAGGTTAATAGAACTTGACCAGTACCTGGATAAAGACCACTATACCCTGATTG
ATCAATCTCCAGTAGCAGCCATCTTGCCAAAAGAAGGTAAATTTGATGAAGTCTATGAAGCACTAACTCACGCT
CATCCTAATCTTACTGTTTACAAAAAGAAGACGTTCCAGAAAGGTGGCATTACAAATACAACAGTCGAATTCA
ACCAATCATAGCAGTGGCTGATGAAGGGTGGCACATTTTACAGAATAAGTCAGATGACTTTCTGTTAGGCAACC
ACGGTTACGATAATGCGTTAGCAGATATGCATCCAATATTTTTAGCCCATGGTCCTGCCTTCAGAAAGAATTTC
TCAAAAGAAGCCATGAACTCCACAGATTTGTACCCACTACTATGCCACCTCCTCAATATCACTGCCATGCCACA
CAATGGATCATTCTGGAATGTCCAGGATCTGCTCAATTCAGCAATGCCAAGGGTGGTCCCTTATACACAGAGTA
CTATACTCCTCCCTGGTAGTGTTAAACCAGCAGAATATGACCAAGAGGGGTCATACCCTTATTTCATAGGGGTC
TCTCTTGGCAGCATTATAGTGATTGTATTTTTTGTAATTTTCATTAAGCATTTAATTCACAGTCAAATACCTGC
CTTACAAGATATGCATGCTGAAATAGCTCAACCATTATTACAAGCCTAATGTTACTTTGAAGTGGATTTGCATA
TTGAAGTGGAGATTCCATAATTATGTCAGTGTTTAAAGGTTTCAAATTCTGGGAAACCAGTTCCAAACATCTGC
AGAAACCATTAAGCAGTTACATATTTAGGTATACACACACACACACACACATACACACACACGGACCAAA
ATACTTACACCTGCAAAGGAATAAAGATGTGAGAGTATGTCTCCATTGTTCACTGTAGCATAGGGATAGATAAG
ATCCTGCTTTATTTGGACTTGGCGCAGATAATGTATATATTTAGCAACTTTGCACTATGTAAAGTACCTTATAT
ATTGCACTTTAAATTTCTCTCCTGATGGGTACTTAATTTGAAATGCACTTTATGGACAGTTATGTCTTATAAC
TTGATTGAAAATGACAACTTTTTGCACCCATGTCACAGAATACTTGTTACGCATTGTTCAAACTGAAGGAAATT
TCTAATAATCCCGAATAATGAACATAGAAATCTATCTCCATAAATTGAGAGAAGAAGAAGGTGATAAGTGTTGA
AAATTAAATGTGATAACCTTTGAACCTTGAATTTTGGAGATGTATTCCCAACAGCAGAATGCAACTGTGGGCAT
TTCTTGTCTTATTTCTTTCCAGAGAACGTGGTTTTCATTTATTTTTCCCTCAAAAGAGAGTCAAATACTGACAG
ATTCGTTCTAAATATATTGTTTCTGTCATAAAATTATTGTGATTTCCTGATGAGTCATATTACTGTGATTTTCA
TAATAATGAAGACACCATGAATATACTTTTCTTCTATATAGTTCAGCAATGGCCTGAATAGAAGCAACCAGGCA
CCATCTCAGCAATGTTTTCTCTTGTTTGTAATTATTTGCTCCTTTGAAAATTAAATCACTATTAATTACATTAA
AAATCAAATTGGATAAAAAAAAAAAAAAAAAAAA
```

FIGURE 202

MTSKFILVSFILAALSLSTTFSLQLDQQKVLLVSFDGFRWDYLYKVPTPHFHYIMKYGVHVK
QVTNVFITKTYPNHYTLVTGLFAENHGIVANDMFDPIRNKSFSLDHMNIYDSKFWEEATPIW
ITNQRAGHTSGAAMWPGTDVKIHKRFPTHYMPYNESVSFEDRVAKIVEWFTSKEPINLGLLY
WEDPDDMGHHLGPDSPLMGPVISDIDKKLGYLIQMLKKAKLWNTLNLIITSDHGMTQCSEER
LIELDQYLDKDHYTLIDQSPVAAILPKEGKFDEVYEALTHAHPNLTVYKKEDVPERWHYKYN
SRIQPIIAVADEGWHILQNKSDDFLLGNHGYDNALADMHPIFLAHGPAFRKNFSKEAMNSTD
LYPLLCHLLNITAMPHNGSFWNVQDLLNSAMPRVVPYTQSTILLPGSVKPAEYDQEGSYPYF
IGVSLGSIIVIVFFVIFIKHLIHSQIPALQDMHAEIAQPLLQA

Signal Peptide:

amino acids 1-22

Transmembrane Domain:

amino acids 429-452

N-glycosylation sites:

amino acids 101-104, 158-161, 292-295, 329-332, 362-365, 369-372, 382-385, 389-392

Somatomedin B Domain:

amino acids 69-85

Sulfatase protein Region:

amino acids 212-241

FIGURE 203

GGATTTTTGTGATCCGCGATTCGCTCCCACGGGCGGGACCTTTGTAACTGCGGGAGGCCCAG
GACAGGCCCACCCTGCGGGGCGGGAGGCAGCCGGGGTGAGGGAGGTGAAGAAACCAAGACGC
AGAGAGGCCAAGCCCCTTGCCTTGGGTCACACAGCCAAAGGAGGCAGAGCCAGAACTCACAA
CCAGATCCAGAGGCAACAGGGACATGGCCACCTGGGACGAAAGGCAGTCACCCGCAGGGCC
AAGGTGGCTCCCGCTGAGAGGATGAGCAAGTTCTTAAGGCACTTCACGGTCGTGGGAGACGA
CTACCATGCCTGGAACATCAACTACAAGAAATGGGAGAATGAAGAGGAGGAGGAGGAGGAGG
AGCAGCCACCACCCACACCAGTCTCAGGCGAGGAAGGCAGAGCTGCAGCCCCTGACGTTGCC
CCTGCCCCTGGCCCCGCACCCAGGGCCCCCCTTGACTTCAGGGGCATGTTGAGGAAACTGTT
CAGCTCCACAGGTTTCAGGTCATCATCATCTGCTTGGTGGTTCTGGATGCCCTCCTGGTGC
TTGCTGAGCTCATCCTGGACCTGAAGATCATCCAGCCCGACAAGAATAACTATGCTGCCATG
GTATTCCACTACATGAGCATCACCATCTTGGTCTTTTTTATGATGGAGATCATCTTTAAATT
ATTTGTCTTCCGCCTGAGTTCTTTCACCACAAGTTTGAGATCCTGGATGCCCGTCGTGGTGG
TGGTCTCATTCATCCTGGACATTGTCCTCCTGTTCCAGGAGCACCAGTTTGAGGCTCTGGGC
CTGCTGATTCTGCTCCGGCTGTGGCGGGTGGCCCGGATCATCAATGGGATTATCATCTCAGT
TAAGACACGTTCAGAACGGCAACTCTTAAGGTTAAAACAGATGAATGTACAATTGGCCGCCA
AGATTCAACACCTTGAGTTCAGCTGCTCTGAGAAGCCCCTGGACTGATGAGTTTGCTGTATC
AACCTGTAAGGAGAAGCTCTCTCCGGATGGCTATGGGAATGAAAGAATCCGACTTCTACTCT
CACACAGCCACCGTGAAAGTCCTGGAGTAAAATGTGCTGTGTACAGAAGAGAGAAGGAAG
CAGGCTGGCATGTTCACTGGGCTGGTGTTACGACAGAGAACCTGACAGTCACTGGCCAGTTA
TCACTTCAGATTACAAATCACACAGAGCATCTGCCTGTTTTCAATCACAAGAGAACAAAACC
AAAATCTATAAGATATTCTGAAAATATGACAGAATTTGACAAATAAAGCATAAACGTGTA
AAAAAAAAAAAAAAAAAAAAAAAAAAAAAAAA

FIGURE 204

MATWDEKAVTRRAKVAPAERMSKFLRHFTVVGDDYHAWNINYKKWENEEEEEEEEQPPPTPV
SGEEGRAAAPDVAPAPGPAPRAPLDFRGMLRKLFSSHRFQVIIICLVVLDALLVLAELILDL
KIIQPDKNNYAAMVFHYMSITILVFFMMEIIFKLFVFRLSSFTTSLRSWMPVVVVVSFILDI
VLLFQEHQFEALGLLILLRLWRVARIINGIIISVKTRSERQLLRLKQMNVQLAAKIQHLEFS
CSEKPLD

FIGURE 205

```
CGGCTCGAGCTCGAGCCGAATCGGCTCGAGGGGCAGTGGAGCACCCAGCAGGCCGCCAACAT
GCTCTGTCTGTGCCTGTACGTGCCGGTCATCGGGGAAGCCCAGACCGAGTTCCAGTACTTTG
AGTCGAAGGGGCTCCCTGCCGAGCTGAAGTCCATTTTCAAGCTCAGTGTCTTCATCCCCTCC
CAGGAATTCTCCACCTACCGCCAGTGGAAGCAGAAAATTGTACAAGCTGGAGATAAGGACCT
TGATGGGCAGCTAGACTTTGAAGAATTTGTCCATTATCTCCAAGATCATGAGAAGAAGCTGA
GGCTGGTGTTTAAGATTTTGGACAAAAAGAATGATGGACGCATTGACGCGCAGGAGATCATG
CAGTCCCTGCGGGACTTGGGAGTCAAGATATCTGAACAGCAGGCAGAAAAAATTCTCAAGAG
CATGGATAAAAACGGCACGATGACCATCGACTGGAACGAGTGGAGAGACTACCACCTCCTCC
ACCCCGTGGAAAACATCCCCGAGATCATCCTCTACTGGAAGCATTCCACGATCTTTGATGTG
GGTGAGAATCTAACGGTCCCGGATGAGTTCACAGTGGAGGAGAGGCAGACGGGGATGTGGTG
GAGACACCTGGTGGCAGGAGGTGGGGCAGGGGCCGTATCCAGAACCTGCACGGCCCCCTGG
ACAGGCTCAAGGTGCTCATGCAGGTCCATGCCTCCCGCAGCAACAACATGGGCATCGTTGGT
GGCTTCACTCAGATGATTCGAGAAGGAGGGGCCAGGTCACTCTGGCGGGGCAATGGCATCAA
CGTCCTCAAAATTGCCCCCGAATCAGCCATCAAATTCATGGCCTATGAGCAGATCAAGCGCC
TTGTTGGTAGTGACCAGGAGACTCTGAGGATTCACGAGAGGCTTGTGGCAGGGTCCTTGGCA
GGGGCCATCGCCCAGAGCAGCATCTACCCAATGGAGGTCCTGAAGACCCGGATGGCGCTGCG
GAAGACAGGCCAGTACTCAGGAATGCTGGACTGCGCCAGGAGGATCCTGGCCAGAGAGGGGG
TGGCCGCCTTCTACAAAGGCTATGTCCCCAACATGCTGGGCATCATCCCCTATGCCGGCATC
GACCTTGCAGTCTACGAGACGCTCAAGAATGCCTGGCTGCAGCACTATGCAGTGAACAGCGC
GGACCCCGGCGTGTTTGTGCTCCTGGCCTGTGGCACCATGTCCAGTACCTGTGGCCAGCTGG
CCAGCTACCCCCTGGCCCTAGTCAGGACCCGGATGCAGGCGCAAGCCTCTATTGAGGGCGCT
CCGGAGGTGACCATGAGCAGCCTCTTCAAACATATCCTGCGGACCGAGGGGCCTTCGGGCT
GTACAGGGGCTGGCCCCCAACTTCATGAAGGTCATCCCAGCTGTGAGCATCAGCTACGTGG
TCTACGAGAACCTGAAGATCACCCTGGGCGTGCAGTCGCGGTGACGGGGGAGGGCCGCCCG
GCAGTGGACTCGCTGATCCTGGGCCGCAGCCTGGGGTGTGCAGCCATCTCATTCTGTGAATG
TGCCAACACTAAGCTGTCTCGAGCCAAGCTGTGAAAACCCTAGACGCACCCGCAGGGAGGGT
GGGGAGAGCTGGCAGGCCCAGGGCTTGTCCTGCTGACCCCAGCAGACCCTCCTGTTGGTTCC
AGCGAAGACCACAGGCATTCCTTAGGGTCCAGGGTCAGCAGGCTCCGGGCTCACATGTGTAA
GGACAGGACATTTTCTGCAGTGCCTGCCAATAGTGAGCTTGGAGCCTGGAGGCCGGCTTAGT
TCTTCCATTTCACCCTTGCAGCCAGCTGTTGGCCACGGCCCCTGCCCTCTGGTCTGCCGTGC
ATCTCCCTGTGCCCTCTTGCTGCCTGCCTGTCTGCTGAGGTAAGGTGGGAGGAGGGCTACAG
CCCACATCCCACCCCCTCGTCCAATCCCATAATCCATGATGAAAGGTGAGGTCACGTGGCCT
CCCAGGCCTGACTTCCCAACCTACAGCATTGACGCCAACTTGGCTGTGAAGGAAGAGGAAAG
GATCTGGCCTTGTGGTCACTGGCATCTGAGCCCTGCTGATGGCTGGGGCTCTCGGGCATGCT
TGGGAGTGCAGGGGCTCGGGCTGCCTGGCCTGGCTGCACAGAAGGCAAGTGCTGGGGCTCA
TGGTGCTCTGAGCTGGCCTGGACCCTGTCAGGATGGGCCCCACCTCAGAACCAAACTCACTG
TCCCCACTGTGGCATGAGGGCAGTGGAGCACCATGTTTGAGGGCGAAGGGCAGAGCGTTTGT
GTGTTCTGGGGAGGGAAGGAAAAGGTGTTGGAGGCCTTAATTATGGACTGTTGGGAAAAGGG
TTTTGTCCAGAAGGACAAGCCGGACAAATGAGCGACTTCTGTGCTTCCAGAGGAAGACGAGG
GAGCAGGAGCTTGGCTGACTGCTCAGAGTCTGTTCTGACGCCCTGGGGGTTCCTGTCCAACC
CCAGCAGGGCGCAGCGGGACCAGCCCCACATTCCACTTGTGTCACTGCTTGGAACCTATTT
ATTTTGTATTTATTTGAACAGAGTTATGTCCTAACTATTTTTATAGATTTGTTTAATTAATA
GCTTGTCATTTTCAAGTTCATTTTTTATTCATATTTATGTTCATGGTTGATTGTACCTTCCC
AAGCCCGCCCAGTGGGATGGGAGGAGGAGGAGAAGGGGGCCTTGGGCCGCTGCAGTCACAT
CTGTCCAGAGAAATTCCTTTTGGGACTGGAGGCAGAAAAGCGGCCAGAAGGCAGCAGCCCTG
GCTCCTTTCCTTTGGCAGGTTGGGGAAGGGCTTGCCCCCAGCCTTAGGATTTCAGGGTTTGA
CTGGGGGCGTGGAGAGAGAGGGAGGAACCTCAATAACCTTGAAGGTGGAATCCAGTTATTTC
CTGCGCTGCGAGGGTTTCTTTATTTCACTCTTTTCTGAATGTCAAGGCAGTGAGGTGCCTCT
CACTGTGAATTTGTGGTGGCGGGGCTGGAGGAGAGGGTGGGGGCTGGCTCCGTCCCTCC
CAGCCTTCTGCTGCCCTTGCTTAACAATGCCGGCCAACTGGCGACCTCACGGTTGCACTTCC
ATTCCACCAGAATGACCTGATGAGGAAATCTTCAATAGGATGCAAAGATCAATGCAAAAATT
GTTATATATGAACATATAACTGGAGTCGTCAAAAAGCAAATTAAGAAAGAATTGGACGTTAG
AAGTTGTCATTTAAAGCAGCCTTCTAATAAAGTTGTTTCAAAGCTGAAAAAAAAAAAAAAAA
AAAAAAAAAAAAAAAAAAAAAAAAAAAAAAAAAAAAAAAAAAAAAAAAA
```

FIGURE 206

MLCLCLYVPVIGEAQTEFQYFESKGLPAELKSIFKLSVFIPSQEFSTYRQWKQKIVQAGDKD
LDGQLDFEEFVHYLQDHEKKLRLVFKILDKKNDGRIDAQEIMQSLRDLGVKISEQQAEKILK
SMDKNGTMTIDWNEWRDYHLLHPVENIPEIILYWKHSTIFDVGENLTVPDEFTVEERQTGMW
WRHLVAGGGAGAVSRTCTAPLDRLKVLMQVHASRSNNMGIVGGFTQMIREGGARSLWRGNGI
NVLKIAPESAIKFMAYEQIKRLVGSDQETLRIHERLVAGSLAGAIAQSSIYPMEVLKTRMAL
RKTGQYSGMLDCARRILAREGVAAFYKGYVPNMLGIIPYAGIDLAVYETLKNAWLQHYAVNS
ADPGVFVLLACGTMSSTCGQLASYPLALVRTRMQAQASIEGAPEVTMSSLFKHILRTEGAFG
LYRGLAPNFMKVIPAVSISYVVYENLKITLGVQSR

Important features:

Signal peptide:

amino acids 1-16

Transmembrane domain:

amino acids 284-304, 339-360, 376-394

Mitochondrial energy transfer proteins signature.

amino acids 206-215, 300-309

N-glycosylation site.

amino acids 129-133, 169-173

Elongation Factor-hand calcium-binding protein.

amino acids 54-73, 85-104, 121-140

FIGURE 207

```
GGAAGGCAGCGGCAGCTCCACTCAGCCAGTACCCAGATACGCTGGGAACCTTCCCCAGCCAT
GGCTTCCCTGGGGCAGATCCTCTTCTGGAGCATAATTAGCATCATCATTATTCTGGCTGGAG
CAATTGCACTCATCATTGGCTTTGGTATTTCAGGGAGACACTCCATCACAGTCACTACTGTC
GCCTCAGCTGGGAACATTGGGGAGGATGGAATCCTGAGCTGCACTTTTGAACCTGACATCAA
ACTTTCTGATATCGTGATACAATGGCTGAAGGAAGGTGTTTTAGGCTTGGTCCATGAGTTCA
AAGAAGGCAAAGATGAGCTGTCGGAGCAGGATGAAATGTTCAGAGGCCGGACAGCAGTGTTT
GCTGATCAAGTGATAGTTGGCAATGCCTCTTTGCGGCTGAAAAACGTGCAACTCACAGATGC
TGGCACCTACAAATGTTATATCATCACTTCTAAAGGCAAGGGGAATGCTAACCTTGAGTATA
AAACTGGAGCCTTCAGCATGCCGGAAGTGAATGTGGACTATAATGCCAGCTCAGAGACCTTG
CGGTGTGAGGCTCCCCGATGGTTCCCCCAGCCCACAGTGGTCTGGGCATCCCAAGTTGACCA
GGGAGCCAACTTCTCGGAAGTCTCCAATACCAGCTTTGAGCTGAACTCTGAGAATGTGACCA
TGAAGGTTGTGTCTGTGCTCTACAATGTTACGATCAACAACACATACTCCTGTATGATTGAA
AATGACATTGCCAAAGCAACAGGGGATATCAAAGTGACAGAATCGGAGATCAAAAGGCGGAG
TCACCTACAGCTGCTAAACTCAAAGGCTTCTCTGTGTGTCTCTTCTTTCTTTGCCATCAGCT
GGGCACTTCTGCCTCTCAGCCCTTACCTGATGCTAAAATAATGTGCCTTGGCCACAAAAAAG
CATGCAAAGTCATTGTTACAACAGGGATCTACAGAACTATTTCACCACCAGATATGACCTAG
TTTTATATTTCTGGGAGGAAATGAATTCATATCTAGAAGTCTGGAGTGAGCAAACAAGAGCA
AGAAACAAAAGAAGCCAAAAGCAGAAGGCTCCAATATGAACAAGATAAATCTATCTTCAAA
GACATATTAGAAGTTGGGAAATAATTCATGTGAACTAGACAAGTGTGTTAAGAGTGATAAG
TAAAATGCACGTGGAGACAAGTGCATCCCCAGATCTCAGGGACCTCCCCCTGCCTGTCACCT
GGGGAGTGAGAGGACAGGATAGTGCATGTTCTTTGTCTCTGAATTTTTAGTTATATGTCTG
TAATGTTGCTCTGAGGAAGCCCCTGGAAAGTCTATCCCAACATATCCACATCTTATATTCCA
CAAATTAAGCTGTAGTATGTACCCTAAGACGCTGCTAATTGACTGCCACTTCGCAACTCAGG
GGCGGCTGCATTTTAGTAATGGGTCAAATGATTCACTTTTTATGATGCTTCCAAAGGTGCCT
TGGCTTCTCTTCCCAACTGACAAATGCCAAAGTTGAGAAAATGATCATAATTTTAGCATAA
ACAGAGCAGTCGGGACACCGATTTTATAAATAAACTGAGCACCTTCTTTTTAAACAAAAAA
AAAAAAAAAAAAAAAAAAAAAAAAAAAAAAAAAAAAAAAAAA
```

FIGURE 208

MASLGQILFWSIISIIIILAGAIALIIGFGISGRHSITVTTVASAGNIGEDGILSCTFEPDI
KLSDIVIQWLKEGVLGLVHEFKEGKDELSEQDEMFRGRTAVFADQVIVGNASLRLKNVQLTD
AGTYKCYIITSKGKGNANLEYKTGAFSMPEVNVDYNASSETLRCEAPRWFPQPTVVWASQVD
QGANFSEVSNTSFELNSENVTMKVVSVLYNVTINNTYSCMIENDIAKATGDIKVTESEIKRR
SHLQLLNSKASLCVSSFFAISWALLPLSPYLMLK

FIGURE 209

GAATTTGTAGAAGACAGCGGCGTTGCCATGGCGGCGTCTCTGGGGCAGGTGTTGGCTCTGGT
GCTGGTGGCCGCTCTGTGGGGTGGCACGCAGCCGCTGCTGAAGCGGGCCTCCGCCGGCCTGC
AGCGGGTTCATGAGCCGACCTGGGCCCAGCAGTTGCTACAGGAGATGAAGACCCTCTTCTTG
AATACTGAGTACCTGATGCCCTTTCTCCTCAACCAGTGTGGATCCCTTCTCTATTACCTCAC
CTTGGCATCGACAGATCTGACCCTGGCTGTGCCCATCTGTAACTCTCTGGCTATCATCTTCA
CACTGATTGTTGGGAAGGCCCTTGGAGAAGATATTGGTGGAAAACGTAAGTTAGACTACTGC
GAGTGCGGGACGCAGCTCTGTGGATCTCGACATACCTGTGTTAGTTCCTTCCCAGAACCCAT
CTCCCCAGAGTGGGTGAGGACACGGCCTTTTCCCATCCTGCCCTTTCCTCTGCAGCTGTTTT
GCTTCCTTGTGGCCATCAGAGTTCCCTTCCCCTGGACAGTCTGGAGAAAGACAGAGGCTGGG
GTTTGGGATTTGAAGACCAGACCCCATCTGAGCCCTTCCTCCAGCCCTGTACCAGCTCCTACT
GGCATGGCTGAGCTCAGACCCTCCTGATTTCTGCCTATTATCCCAGGAGCAGTTGCTGGCAT
GGTGCTCACCGTGATAGGAATTTCACTCTGCATCACAAGCTCAGTGAGTAAGACCCAGGGGC
AACAGTCTACCCTTTGAGTGGGCCGAACCCACTTCCAGCTCTGCTGCCTCCAGGAAGCCCCT
GGGCCATGAAGTGCTGGCAGTGAGCGGATGGACCTAGCACTTCCCCTCTCTGGCCTTAGCTT
CCTCCTCTCTTATGGGGATAACAGCTACCTCATGGATCACAATAAGAGAACAAGAGTGAAAG
AGTTTTGTAACCTTCAAGTGCTGTTCAGCTGCGGGGATTTAGCACAGGAGACTCTACGCTCA
CCCTCAGCAACCTTTCTGCCCCAGCAGCTCTCTTCCTGCTAACATCTCAGGCTCCCAGCCCA
GCCACCATTACTGTGGCCTGATCTGGACTATCATGGTGGCAGGTTCCATGGACTGCAGAACT
CCAGCTGCATGGAAAGGGCCAGCTGCAGACTTTGAGCCAGAAATGCAAACGGGAGGCCTCTG
GGACTCAGTCAGAGCGCTTTGGCTGAATGAGGGGTGGAACCGAGGGAAGAAGGTGCGTCGGA
GTGGCAGATGCAGGAAATGAGCTGTCTATTAGCCTTGCCTGCCCCACCCATGAGGTAGGCAG
AAATCCTCACTGCCAGCCCTCTTAAACAGGTAGAGAGCTGTGAGCCCCAGCCCCACCTGAC
TCCAGCACACCTGGCGAGTAGTAGCTGTCAATAAATCTATGTAAACAGACAAAAAAAAAAA
AAAAAAAAAAAAAAAAAAAAAAAAAAAAAAAAAAAAAAAAAAAAAAAAAAAA

FIGURE 210

MAASLGQVLALVLVAALWGGTQPLLKRASAGLQRVHEPTWAQQLLQEMKTLFLNTEYLMPFL
LNQCGSLLYYLTLASTDLTLAVPICNSLAIIFTLIVGKALGEDIGGKRKLDYCECGTQLCGS
RHTCVSSFPEPISPEWVRTRPFPILPFPLQLFCFLVAIRVPFPWTVWRKTEAGVWD

FIGURE 211

CTTCTGTAGGACAGTCACCAGGCCAGATCCAGAAGCCTCTCTAGGCTCCAGCTTTCTCTGTG
GAAGATGACAGCAATTATAGCAGGACCCTGCCAGGCTGTCGAAAAGATTCCGCAATAAAACT
TTGCCAGTGGGAAGTACCTAGTGAAACGGCCTAAGATGCCACTTCTTCTCATGTCCCAGGCT
TGAGGCCCTGTGGTCCCCATCCTTGGGAGAAGTCAGCTCCAGCACCATGAAGGGCATCCTCG
TTGCTGGTATCACTGCAGTGCTTGTTGCAGCTGTAGAATCTCTGAGCTGCGTGCAGTGTAAT
TCATGGAAAAATCCTGTGTCAACAGCATTGCCTCTGAATGTCCCTCACATGCCAACACCAG
CTGTATCAGCTCCTCAGCCAGCTCCTCTAGAGACACCAGTCAGATTATACCAGAATATGT
TCTGCTCAGCGGAGAACTGCAGTGAGGAGACACACATTACAGCCTTCACTGTCCACGTGTCT
GCTGAAGAACACTTTCATTTGTAAGCCAGTGCTGCCAAGGAAAGGAATGCAGCAACACCAG
CGATGCCCTGGACCCTCCCCTGAAGAACGTGTCCAGCAACGCAGAGTGCCCTGCTTGTTATG
AATCTAATGGAACTTCCTGTCGTGGGAAGCCCTGGAAATGCTATGAAGAAGAACAGTGTGTC
TTTCTAGTTGCAGAACTTAAGAATGACATTGAGTCTAAGAGTCTCGTGCTGAAAGGCTGTTC
CAACGTCAGTAACGCCACCTGTCAGTTCCTGTCTGGTGAAAACAAGACTCTTGGAGGAGTCA
TCTTTCGAAAGTTTGAGTGTGCAAATGTAAACAGCTTAACCCCCACGTCTGCACCAACCACT
TCCCACAACGTGGGCTCCAAAGCTTCCCTCTACCTCTTGGCCCTTGCCAGCCTCCTTCTTCG
GGGACTGCTGCCCTGAGGTCCTGGGGCTGCACTTTGCCCAGCACCCCATTTCTGCTTCTCTG
AGGTCCAGAGCACCCCCTGCGGTGCTGACACCCTCTTTCCCTGCTCTGCCCCGTTTAACTGC
CCAGTAAGTGGGAGTCACAGGTCTCCAGGCAATGCCGACAGCTGCCTTGTTCTTCATTATTA
AAGCACTGGTTCATTCACTGCCAAAAAAAAAAAAAAAAAAAAAAAAA

FIGURE 212

MKGILVAGITAVLVAAVESLSCVQCNSWEKSCVNSIASECPSHANTSCISSSASSSLETPVR
LYQNMFCSAENCSEETHITAFTVHVSAEEHFHFVSQCCQGKECSNTSDALDPPLKNVSSNAE
CPACYESNGTSCRGKPWKCYEEEQCVFLVAELKNDIESKSLVLKGCSNVSNATCQFLSGENK
TLGGVIFRKFECANVNSLTPTSAPTTSHNVGSKASLYLLALASLLLRGLLP

FIGURE 213

GGCCTCGGTTCAAACGACCCGGTGGGTCTACAGCGGAAGGGAGGGAGCGAAGGTAGGAGGCA
GGGCTTGCCTCACTGGCCACCCTCCCAACCCCAAGAGCCCAGCCCCATGGTCCCCGCCGCCG
GCGCGCTGCTGTGGGTCCTGCTGCTGAATCTGGGTCCCCGGGCGGCGGGGCCCAAGGCCTG
ACCCAGACTCCGACCGAAATGCAGCGGGTCAGTTTACGCTTTGGGGGCCCCATGACCCGCAG
CTACCGGAGCACCGCCCGGACTGGTCTTCCCCGGAAGACAAGGATAATCCTAGAGGACGAGA
ATGATGCCATGGCCGACGCCGACCGCCTGGCTGGACCAGCGGCTGCCGAGCTCTTGGCCGCC
ACGGTGTCCACCGGCTTTAGCCGGTCGTCCGCCATTAACGAGGAGGATGGGTCTTCAGAAGA
GGGGGTTGTGATTAATGCCGGAAAGGATAGCACCAGCAGAGAGCTTCCCAGTGCGACTCCCA
ATACAGCGGGGAGTTCCAGCACGAGGTTTATAGCCAATAGTCAGGAGCCTGAAATCAGGCTG
ACTTCAAGCCTGCCGCGCTCCCCGGGAGGTCTACTGAGGACCTGCCAGGCTCGCAGGCCAC
CCTGAGCCAGTGGTCCACACCTGGGTCTACCCCGAGCCGGTGGCCGTCACCCTCACCCACAG
CCATGCCATCTCCTGAGGATCTGCGGCTGGTGCTGATGCCCTGGGGCCCGTGGCACTGCCAC
TGCAAGTCGGGCACCATGAGCCGGAGCCGGTCTGGGAAGCTGCACGGCCTTTCCGGGCGCCT
TCGAGTTGGGGCGCTGAGCCAGCTCCGCACGGAGCACAAGCCTTGCACCTATCAACAATGTC
CCTGCAACCGACTTCGGGAAGAGTGCCCCCTGGACACAAGTCTCTGTACTGACACCAACTGT
GCCTCTCAGAGCACCACCAGTACCAGGACCACCACTACCCCCTTCCCCACCATCCACCTCAG
AAGCAGTCCCAGCCTGCCACCCGCCAGCCCTGCCCAGCCCTGGCTTTTTGGAAACGGGTCA
GGATTGGCCTGGAGGATATTTGGAATAGCCTCTCTTCAGTGTTCACAGAGATGCAACCAATA
GACAGAAACCAGAGGTAATGGCCACTTCATCCACATGAGGAGATGTCAGTATCTCAACCTCT
CTTGCCCTTTCAATCCTAGCACCCACTAGATATTTTTAGTACAGAAAAACAAAACTGGAAAA
CACAA

FIGURE 214

MVPAAGALLWVLLLNLGPRAAGAQGLTQTPTEMQRVSLRFGGPMTRSYRSTARTGLPRKTRI
ILEDENDAMADADRLAGPAAAELLAATVSTGFSRSSAINEEDGSSEEGVVINAGKDSTSREL
PSATPNTAGSSSTRFIANSQEPEIRLTSSLPRSPGRSTEDLPGSQATLSQWSTPGSTPSRWP
SPSPTAMPSPEDLRLVLMPWGPWHCHCKSGTMSRSRSGKLHGLSGRLRVGALSQLRTEHKPC
TYQQCPCNRLREECPLDTSLCTDTNCASQSTTSTRTTTTPFPTIHLRSSPSLPPASPCPALA
FWKRVRIGLEDIWNSLSSVFTEMQPIDRNQR

FIGURE 215

```
CCCGGGTCGACCCACGCGTCCGGGGAGAAAGGATGGCCGGCCTGGCGGCGCGGTTGGTCCTGCTAGCTGGGGCA
GCGGCGCTGGCGAGCGGCTCCCAGGGCGACCGTGAGCCGGTGTACCGCGACTGCGTACTGCAGTGCGAAGAGCA
GAACTGCTCTGGGGGCGCTCTGAATCACTTCCGCTCCCGCCAGCCAATCTACATGAGTCTAGCAGGCTGGACCT
GTCGGGACGACTGTAAGTATGAGTGTATGTGGGTCACCGTTGGGCTCTACCTCCAGGAAGGTCACAAAGTGCCT
CAGTTCCATGGCAAGTGGCCCTTCTCCCGGTTCCTGTTCTTTCAAGAGCCGGCATCGGCCGTGGCCTCGTTTCT
CAATGGCCTGGCCAGCCTGGTGATGCTCTGCCGCTACCGCACCTTCGTGCCAGCCTCCTCCCCCATGTACCACA
CCTGTGTGGCCTTCGCCTGGGTGTCCCTCAATGCATGGTTCTGGTCCACAGTCTTCCACACCAGGGACACTGAC
CTCACAGAGAAAATGGACTACTTCTGTGCCTCCACTGTCATCCTACACTCAATCTACCTGTGCTGCGTCAGGAC
CGTGGGGCTGCAGCACCCAGCTGTGGTCAGTGCCTTCCGGGCTCTCCTGCTGCTCATGCTGACCGTGCACGTCT
CCTACCTGAGCCTCATCCGCTTCGACTATGGCTACAACCTGGTGGCCAACGTGGCTATTGGCCTGGTCAACGTG
GTGTGGTGGCTGGCCTGGTGCCTGTGGAACCAGCGGCGGCTGCCTCACGTGCGCAAGTGCGTGGTGGTGGTCTT
GCTGCTGCAGGGGCTGTCCCTGCTCGAGCTGCTTGACTTCCCACCGCTCTTCTGGGTCCTGGATGCCCATGCCA
TCTGGCACATCAGCACCATCCCTGTCCACGTCCTCTTTTTCAGCTTTCTGGAAGATGACAGCCTGTACCTGCTG
AAGGAATCAGAGGACAAGTTCAAGCTGGACTGAAGACCTTGGAGCGAGTCTGCCCCAGTGGGGATCCTGCCCCC
GCCCTGCTGGCCTCCCTTCTCCCCTCAACCCTTGAGATGATTTTCTCTTTTCAACTTCTTGAACTTGGACATGA
AGGATGTGGGCCCAGAATCATGTGGCCAGCCCACCCCCTGTTGGCCCTCACCAGCCTTGGAGTCTGTTCTAGGG
AAGGCCTCCCAGCATCTGGGACTCGAGAGTGGGCAGCCCCTCTACCTCCTGGAGCTGAACTGGGGTGGAACTGA
GTGTGTTCTTAGCTCTACCGGGAGGACAGCTGCCTGTTTCCTCCCCACCAGCCTCCTCCCCACATCCCCAGCTG
CCTGGCTGGGTCCTGAAGCCCTCTGTCTACCTGGGAGACCAGGGACCACAGGCCTTAGGGATACAGGGGGTCCC
CTTCTGTTACCACCCCCCACCCTCCTCCAGGACACCACTAGGTGGTGCTGGATGCTTGTTCTTTGGCCAGCCAA
GGTTCACGGCGATTCTCCCCATGGGATCTTGAGGGACCAAGCTGCTGGGATTGGGAAGGAGTTTCACCCTGACC
GTTGCCCTAGCCAGGTTCCCAGGAGGCCTCACCATACTCCCTTTCAGGGCCAGGGCTCCAGCAAGCCCAGGGCA
AGGATCCTGTGCTGCTGTCTGGTTGAGAGCCTGCCACCGTGTCGGGAGTGTGGGCCAGGCTGAGTGCATAGG
TGACAGGGCCGTGAGCATGGGCCTGGGTGTGTGTGAGCTCAGGCCTAGGTGCGCAGTGTGGAGACGGGTGTTGT
CGGGGAAGAGGTGTGGCTTCAAAGTGTGTGTGTGCAGGGGGTGGGTGTGTTAGCGTGGGTTAGGGGAACGTGTG
TGCGCGTGCTGGTGGGCATGTGAGATGAGTGACTGCCGGTGAATGTGTCCACAGTTGAGAGGTTGGAGCAGGAT
GAGGGAATCCTGTCACCATCAATAATCACTTGTGGAGCGCCAGCTCTGCCCAAGACGCCACCTGGGCGACAGC
CAGGAGCTCTCCATGGCCAGGCTGCCTGTGTGCATGTTCCCTGTCTGGTGCCCCTTTGCCCGCCTCCTGCAAAC
CTCACAGGGTCCCCACACAACAGTGCCCTCCAGAAGCAGCCCCTCGGAGGCAGAGGAAGGAAAATGGGGATGGC
TGGGGCTCTCTCCATCCTCCTTTTCTCCTTGCCTTCGCATGGCTGGCCTTCCCCTCCAAAACCTCCATTCCCCT
GCTGCCAGCCCCTTTGCCATAGCCTGATTTTGGGGAGGAGGAAGGGGCGATTTGAGGGAGAAGGGGAGAAAGCT
TATGGCTGGGTCTGGTTTCTTCCCTTCCCAGAGGGTCTTACTGTTCCAGGGTGGCCCCAGGGCAGGCAGGGGCC
ACACTATGCCTGTGCCCTGGTAAAGGTGACCCCTGCCATTTACCAGCAGCCCTGGCATGTTCCTGCCCCACAGG
AATAGAATGGAGGGAGCTCCAGAAACTTTCCATCCCAAAGGCAGTCTCCGTGGTTGAAGCAGACTGGATTTTTG
CTCTGCCCCTGACCCCTTGTCCCTCTTTGAGGGAGGGGAGCTATGCTAGGACTCCAACCTCAGGGACTCGGGTG
GCCTGCGCTAGCTTCTTTTGATACTGAAAACTTTTAAGGTGGGAGGGTGGCAAGGGATGTGCTTAATAAATCAA
TTCCAAGCCTCAAAAAAAAAAAAAAAAA
```

FIGURE 216

MAGLAARLVLLAGAAALASGSQGDREPVYRDCVLQCEEQNCSGGALNHFRSRQPIYMSLAGW
TCRDDCKYECMWVTVGLYLQEGHKVPQFHGKWPFSRFLFFQEPASAVASFLNGLASLVMLCR
YRTFVPASSPMYHTCVAFAWVSLNAWFWSTVFHTRDTDLTEKMDYFCASTVILHSIYLCCVR
TVGLQHPAVVSAFRALLLLMLTVHVSYLSLIRFDYGYNLVANVAIGLVNVVWWLAWCLWNQR
RLPHVRKCVVVVLLLQGLSLLELLDFPPLFWVLDAHAIWHISTIPVHVLFFSFLEDDSLYLL
KESEDKFKLD

Important features:

Signal peptide:

amino acids 1-20

Transmembrane domains:

amino acids 105-123, 138-156, 169-185, 193-209, 221-240, 256-272

N-glycosylation site.

amino acids 40-44

N-myristoylation site.

amino acids 43-49

CUB domain proteins profile.

amino acids 285-302

Amiloride-sensitive sodium channels proteins.

amino acids 162-186

FIGURE 217

```
GGCCGCCTGGAATTGTGGGAGTTGTGTCTGCCACTCGGCTGCCGGAGGCCGAAGGTCCGTGA
CTATGGCTCCCCAGAGCCTGCCTTCATCTAGGATGGCTCCTCTGGGCATGCTGCTTGGGCTG
CTGATGGCCGCCTGCTTCACCTTCTGCCTCAGTCATCAGAACCTGAAGGAGTTTGCCCTGAC
CAACCCAGAGAAGAGCAGCACCAAAGAAACGGAGAGAAAAGAAACCAAAGCCGAGGAGGAGC
TGGATGCCGAAGTCCTGGAGGTGTTCCACCCGACGCATGAGTGGCAGGCCCTTCAGCCAGGG
CAGGCTGTCCCTGCAGGATCCCACGTACGGCTGAATCTTCAGACTGGGGAAAGAGAGGCAAA
ACTCCAATATGAGGACAAGTTCCGAAATAATTTGAAAGGCAAAAGGCTGGATATCAACACCA
ACACCTACACATCTCAGGATCTCAAGAGTGCACTGGCAAAATTCAAGGAGGGGCAGAGATG
GAGAGTTCAAAGGAAGACAAGGCAAGGCAGGCTGAGGTAAAGCGGCTCTTCCGCCCCATTGA
GGAACTGAAGAAAGACTTTGATGAGCTGAATGTTGTCATTGAGACTGACATGCAGATCATGG
TACGGCTGATCAACAAGTTCAATAGTTCCAGCTCCAGTTTGGAAGAGAAGATTGCTGCGCTC
TTTGATCTTGAATATTATGTCCATCAGATGGACAATGCGCAGGACCTGCTTTCCTTTGGTGG
TCTTCAAGTGGTGATCAATGGGCTGAACAGCACAGAGCCCCTCGTGAAGGAGTATGCTGCGT
TTGTGCTGGGCGCTGCCTTTTCCAGCAACCCCAAGGTCCAGGTGGAGGCCATCGAAGGGGGA
GCCCTGCAGAAGCTGCTGGTCATCCTGGCCACGGAGCAGCCGCTCACTGCAAAGAAGAAGGT
CCTGTTTGCACTGTGCTCCCTGCTGCGCCACTTCCCCTATGCCCAGCGGCAGTTCCTGAAGC
TCGGGGGGCTGCAGGTCCTGAGGACCCTGGTGCAGGAGAAGGGCACGGAGGTGCTCGCCGTG
CGCGTGGTCACACTGCTCTACGACCTGGTCACGGAGAAGATGTTCGCCGAGGAGGAGGCTGA
GCTGACCCAGGAGATGTCCCCAGAGAAGCTGCAGCAGTATCGCCAGGTACACCTCCTGCCAG
GCCTGTGGGAACAGGGCTGGTGCGAGATCACGGCCCACCTCCTGGCGCTGCCCGAGCATGAT
GCCCGTGAGAAGGTGCTGCAGACACTGGGCGTCCTCCTGACCACCTGCCGGGACCGCTACCG
TCAGGACCCCCAGCTCGGCAGGACACTGGCCAGCCTGCAGGCTGAGTACCAGGTGCTGGCCA
GCCTGGAGCTGCAGGATGGTGAGGACGAGGGCTACTTCCAGGAGCTGCTGGGCTCTGTCAAC
AGCTTGCTGAAGGAGCTGAGATGAGGCCCCACACCAGGACTGGACTGGGATGCCGCTAGTGA
GGCTGAGGGGTGCCAGCGTGGGTGGGCTTCTCAGGCAGGAGGACATCTTGGCAGTGCTGGCT
TGGCCATTAAATGGAAACCTGAAGGCCAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAA
```

FIGURE 218

MAPQSLPSSRMAPLGMLLGLLMAACFTFCLSHQNLKEFALTNPEKSSTKETERKETKAEEEL
DAEVLEVFHPTHEWQALQPGQAVPAGSHVRLNLQTGEREAKLQYEDKFRNNLKGKRLDINTN
TYTSQDLKSALAKFKEGAEMESSKEDKARQAEVKRLFRPIEELKKDFDELNVVIETDMQIMV
RLINKFNSSSSSLEEKIAALFDLEYYVHQMDNAQDLLSFGGLQVVINGLNSTEPLVKEYAAF
VLGAAFSSNPKVQVEAIEGGALQKLLVILATEQPLTAKKKVLFALCSLLRHFPYAQRQFLKL
GGLQVLRTLVQEKGTEVLAVRVVTLLYDLVTEKMFAEEEAELTQEMSPEKLQQYRQVHLLPG
LWEQGWCEITAHLLALPEHDAREKVLQTLGVLLTTCRDRYRQDPQLGRTLASLQAEYQVLAS
LELQDGEDEGYFQELLGSVNSLLKELR

Important features:

Signal peptide:

amino acids 1-29

Hypothetical YJL126w/YLR351c/yhcX family protein.

amino acids 364-373

N-glycosylation site.

amino acids 193-197, 236-240

N-myristoylation site.

amino acids 15-21, 19-25, 234-240, 251-257, 402-408, 451-457

Homologous region SLS1 protein.

amino acids 68-340

FIGURE 219

```
TTCGGCTTCCGTAGAGGAAGTGGCGCGGACCTTCATTTGGGGTTTCGGTTCCCCCCCTTCCC
CTTCCCCGGGGTCTGGGGGTGACATTGCACCGCGCCCTCGTGGGGTCGCGTTGCCACCCCA
CGCGGACTCCCCAGCTGGCGCGCCCCTCCCATTTGCCTGTCCTGGTCAGGCCCCACCCCCC
TTCCCACCTGACCAGCCATGGGGGCTGCGGTGTTTTCGGCTGCACTTTCGTCGCGTTCGGC
CCGGCCTTCGCGCTTTTCTTGATCACTGTGGCTGGGGACCCGCTTCGCGTTATCATCCTGGT
CGCAGGGGCATTTTTCTGGCTGGTCTCCCTGCTCCTGGCCTCTGTGGTCTGGTTCATCTTGG
TCCATGTGACCGACCGGTCAGATGCCCGGCTCCAGTACGGCCTCCTGATTTTTGGTGCTGCT
GTCTCTGTCCTTCTACAGGAGGTGTTCCGCTTTGCCTACTACAAGCTGCTTAAGAAGGCAGA
TGAAGGGTTAGCATCGCTGAGTGAGGACGGAAGATCACCCATCTCCATCCGCCAGATGGCCT
ATGTTTCTGGTCTCTCCTTCGGTATCATCAGTGGTGTCTTCTCTGTTATCAATATTTTGGCT
GATGCACTTGGGCCAGGTGTGGTTGGGATCCATGGAGACTCACCCTATTACTTCCTGACTTC
AGCCTTTCTGACAGCAGCCATTATCCTGCTCCATACCTTTTGGGGAGTTGTGTTCTTTGATG
CCTGTGAGAGGAGACGGTACTGGGCTTTGGGCCTGGTGGTTGGGAGTCACCTACTGACATCG
GGACTGACATTCCTGAACCCCTGGTATGAGGCCAGCCTGCTGCCCATCTATGCAGTCACTGT
TTCCATGGGGCTCTGGGCCTTCATCACAGCTGGAGGGTCCCTCCGAAGTATTCAGCGCAGCC
TCTTGTGTAAGGACTGACTACCTGGACTGATCGCCTGACAGATCCCACCTGCCTGTCCACTG
CCCATGACTGAGCCCAGCCCCAGCCCGGGTCCATTGCCCACATTCTCTGTCTCCTTCTCGTC
GGTCTACCCCACTACCTCCAGGGTTTTGCTTTGTCCTTTTGTGACCGTTAGTCTCTAAGCTT
TACCAGGAGCAGCCTGGGTTCAGCCAGTCAGTGACTGGTGGGTTTGAATCTGCACTTATCCC
CACCACCTGGGGACCCCCTTGTTGTGTCCAGGACTCCCCCTGTGTCAGTGCTCTGCTCTCAC
CCTGCCCAAGACTCACCTCCCTTCCCCTCTGCAGGCCGACGGCAGGAGGACAGTCGGGTGAT
GGTGTATTCTGCCCTGCGCATCCCACCCGAGGACTGAGGGAACCTAGGGGGGACCCCTGGGC
CTGGGGTGCCCTCCTGATGTCCTCGCCCTGTATTTCTCCATCTCCAGTTCTGGACAGTGCAG
GTTGCCAAGAAAAGGGACCTAGTTTAGCCATTGCCCTGGAGATGAAATTAATGGAGGCTCAA
GGATAGATGAGCTCTGAGTTTCTCAGTACTCCCTCAAGACTGGACATCTTGGTCTTTTTCTC
AGGCCTGAGGGGGAACCATTTTGGTGTGATAAATACCCTAAACTGCCTTTTTTTCTTTTTT
GAGGTGGGGGAGGGAGGAGGTATATTGGAACTCTTCTAACCTCCTTGGGCTATATTTTCTC
TCCTCGAGTTGCTCCTCATGGCTGGGCTCATTTCGGTCCCTTTCTCCTTGGTCCCAGACCTT
GGGGGAAAGGAAGGAAGTGCATGTTTGGGAACTGGCATTACTGGAACTAATGGTTTTAACCT
CCTTAACCACCAGCATCCCTCCTCTCCCCAAGGTGAAGTGGAGGGTGCTGTGGTGAGCTGGC
CACTCCAGAGCTGCAGTGCCACTGGAGGAGTCAGACTACCATGACATCGTAGGGAAGGAGGG
GAGATTTTTTGTAGTTTTAATTGGGGTGTGGGAGGGGCGGGGAGGTTTTCTATAAACTGT
ATCATTTTCTGCTGAGGGTGGAGTGTCCCATCCTTTTAATCAAGGTGATTGTGATTTTGACT
AATAAAAAGAATTTGTAAAAAAAAAAAAAAAAAAAAAAAAAAAAAAAAAAAAAAAAAAAA
AAAAAAAAAAAAAAAAAAAAAAAAAA
```

FIGURE 220

MGAAVFFGCTFVAFGPAFALFLITVAGDPLRVIILVAGAFFWLVSLLLASVVWFILVHVTDR
SDARLQYGLLIFGAAVSVLLQEVFRFAYYKLLKKADEGLASLSEDGRSPISIRQMAYVSGLS
FGIISGVFSVINILADALGPGVVGIHGDSPYYFLTSAFLTAAIILLHTFWGVVFFDACERRR
YWALGLVVGSHLLTSGLTFLNPWYEASLLPIYAVTVSMGLWAFITAGGSLRSIQRSLLCKD

FIGURE 221

AAGCTGGTTTAAGGAAGCAGAGGAGGGTTAGATTCGTTGAGTGAGGACGGAAGATCAACCCA
TTTCCATTCCGCCAGATGGCCTATGTTTCTGGTCTCTCCCTTCGGNATCATCAGTGGTGTNT
TNTCTGTTATCAATATTTTGGCTGATGCANTTGGGCCAGGTGTGGTTGGGATCCATGGAGAC
TCACCCTATTANTTCCTGANTTCAGCCTTTNTGACAGCAGCCATTATCCTGCTC

FIGURE 222

```
GACCGACCGTTCAGATGCCCGGTTCCAGTACGGCTTCCTGATTTTTGGTGCTGCTGTNTCTG
TCCTTCTACAGGAGGTGTTCCGCTTTGCCTANTACAAGCTGCTTAAGAAGGCAGATGAGGGG
TTAGCATNGCTGAGTGAGGACGGAAGATCACCCATTTCCATCCGCCAGATGGCCTATGTTTN
TGGTNTTTCCTTCGGTATCATCAGTGGTGTTTTNTCTGTTATCAATATTTTGGNTGATGCAN
TTGGGCCAGGTGTGGTTGGGATCCATGGAGANTCACCCTATTAATTCCTGAATTCAGCCTTT
NTGACAGCAGCCATTATCCTGNTCCATACCTTTTGGGGAGTTGTGTTTTTTGATGCCTGTGA
GAGGAG
```

FIGURE 223

```
NGTTGGAGAAGTGGCGCGGACNTTCATTTGGGGTTTCGGTTTCCCCCCTTTCCCTTTCCCCG
GGGTCTGGGGTGACATTGCACGGGCCCCTCGTGGGGTCGCGTTGCCACCCCACGCGGACTCC
CCAGNTGGNGCGCCCTTCCCATTTGCCTGTCCTGGTCAGGCCCCCACCCCCCTTCCCACNTG
ACCAGCCATGGGGGCTGCGGTGTTTTTCGGCTGCACTTTCGTCGCGTTCGGCCCGGCCTTCG
CGCTTTTCTTGATCACTGTGGCTGGGGACCCGCTTCGCGTTATCATCCTGGTCGCAGGGGCA
TTTTTCTGGCTGGTCTCCCTGCTCCTGGCCTCTGTGGTCTGGTTCATCTTGGTCCATGTGAC
CGACCGGTCAGATGCCCGGCTCCAGTACGGCCTCCTGATTTTTGGTGCTGCTGTCTCTGTCC
TTCTACAGGAGGTGTTCCGCTTTGCCTACTACAAGCTGCTTAAGAAGGCAGATGAGGGGTTA
GCATCGCTGAGTGAGGACGGAAGATCACCCATCTCCATCCGCCAGATGGCCTATGTTTCTGG
TCTCTCCTTCGGTATCATCAGTGGTGTCTTCTCTGTTATCAATATTTTGGCTGATGCACTTG
GGCCAGGTGTGGTTGGGATCCATGGAGACTCACCC
```

FIGURE 224

```
GTAAAAGAAAGTGGCCGGACCTTCATTGGGGTTTCGGTTCCCCCCTTTCCCNTTCCCCGGGG
TCTGGGGGTGACATTGCACCGCGCCCNTCGTGGGGTCGCGTTGCCACCCCACGCGGACTCCC
CAGNTGGCGCGCCCCTCCCATTTGCCTGTCCTGGTCAGGCCCCCACCCCCCTTCCCACCTGA
CCAGCCATGGGGGCTGCGGTGTTTTTCGGGCTGCACTTTCGTCGCGTTCGGGCCCGGCCTTC
GCGCTTTTCTTGATCACTGTGGCTGGGGACCCGCTTCGCGTTATCATCCTGGTCGCAGGGGC
ATTTTTCTGGCTGGTCTCCCTGCTCCTGGCCTCTGTGGTCTGGTTCATCTTGGTCCATGTGA
CCGACCGGTCAGATGCCCGGCTCCAGTACGGCCTCCTGATTTTTGGTGCTGCTGTCTCTGTC
CTTCTACAGGAGGTGTTCCGCTTTGCCTACTACAAGCTGCTTAAGAAGGCAGATGAGGGGTT
AGCATCGCTGAGTGAGGACGGAAGATCACCCATCTCCATCCGCCAGATGGCCTATGTTTCTG
GTCTCTCCTTCGGTATCATCAGTGGTGTCTTCTCTGTTATCAATATTTTGGCTGATGCACTT
GGGCCAGGTGTGGTTGGGATCCATGGAGAC
```

FIGURE 225

GCCCCAGGGAGCAGTGGGTGGTTATAACTCAGGCCCGGTGCCCAGAGCCCAGGAGGAGGCAG
TGGCCAGGAAGGCACAGGCCTGAGAAGTCTGCGGCTGAGCTGGGAGCAAATCCCCCACCCCC
TACCTGGGGACAGGGCAAGTGAGACCTGGTGAGGGTGGCTCAGCAGGCAGGGAAGGAGAGG
TGTCTGTGCGTCCTGCACCCACATCTTTCTCTGTCCCCTCCTTGCCCTGTCTGGAGGCTGCT
AGACTCCTATCTTCTGAATTCTATAGTGCCTGGGTCTCAGCGCAGTGCCGATGGTGGCCCGT
CCTTGTGGTTCCTCTCTACCTGGGGAAATAAGGTGCAGCGGCCATGGCTACAGCAAGACCCC
CCTGGATGTGGGTGCTCTGTGCTCTGATCACAGCCTTGCTTCTGGGGGTCACAGAGCATGTT
CTCGCCAACAATGATGTTTCCTGTGACCACCCCTCTAACACCGTGCCCTCTGGGAGCAACCA
GGACCTGGGAGCTGGGGCCGGGGAAGACGCCCGGTCGGATGACAGCAGCAGCCGCATCATCA
ATGGATCCGACTGCGATATGCACACCCAGCCGTGGCAGGCCGCGCTGTTGCTAAGGCCCAAC
CAGCTCTACTGCGGGGCGGTGTTGGTGCATCCACAGTGGCTGCTCACGGCCGCCCACTGCAG
GAAGAAAGTTTTCAGAGTCCGTCTCGGCCACTACTCCCTGTCACCAGTTTATGAATCTGGGC
AGCAGATGTTCCAGGGGGTCAAATCCATCCCCCACCCTGGCTACTCCCACCCTGGCCACTCT
AACGACCTCATGCTCATCAAACTGAACAGAAGAATTCGTCCCACTAAAGATGTCAGACCCAT
CAACGTCTCCTCTCATTGTCCCTCTGCTGGGACAAAGTGCTTGGTGTCTGGCTGGGGACAA
CCAAGAGCCCCCAAGTGCACTTCCCTAAGGTCCTCCAGTGCTTGAATATCAGCGTGCTAAGT
CAGAAAAGGTGCGAGGATGCTTACCCGAGACAGATAGATGACACCATGTTCTGCGCCGGTGA
CAAAGCAGGTAGAGACTCCTGCCAGGGTGATTCTGGGGGGCCTGTGGTCTGCAATGGCTCCC
TGCAGGGACTCGTGTCCTGGGGAGATTACCCTTGTGCCCGGCCCAACAGACCGGGTGTCTAC
ACGAACCTCTGCAAGTTCACCAAGTGGATCCAGGAAACCATCCAGGCCAACTCCTGAGTCAT
CCCAGGACTCAGCACACCGGCATCCCCACCTGCTGCAGGGACAGCCCTGACACTCCTTTCAG
ACCCTCATTCCTTCCCAGAGATGTTGAGAATGTTCATCTCTCCAGCCCCTGACCCCATGTCT
CCTGGACTCAGGGTCTGCTTCCCCCACATTGGGCTGACCGTGTCTCTAGTTGAACCCTGG
GAACAATTTCCAAAACTGTCCAGGGCGGGGGTTGCGTCTCAATCTCCCTGGGGCACTTTCAT
CCTCAAGCTCAGGGCCCATCCCTTCTCTGCAGCTCTGACCCAAATTTAGTCCCAGAAATAAA
CTGAGAAGTGGAAAAAAAA

FIGURE 226

MATARPPWMWVLCALITALLLGVTEHVLANNDVSCDHPSNTVPSGSNQDLGAGAGEDARSDD
SSSRIINGSDCDMHTQPWQAALLLRPNQLYCGAVLVHPQWLLTAAHCRKKVFRVRLGHYSLS
PVYESGQQMFQGVKSIPHPGYSHPGHSNDLMLIKLNRRIRPTKDVRPINVSSHCPSAGTKCL
VSGWGTTKSPQVHFPKVLQCLNISVLSQKRCEDAYPRQIDDTMFCAGDKAGRDSCQGDSGGP
VVCNGSLQGLVSWGDYPCARPNRPGVYTNLCKFTKWIQETIQANS

FIGURE 227

```
ATGGTCAACGACCGGTGGAAGACCATGGGCGGCGCTGCCCAACTTGAGGACCGGCCGCGCGA
CAAGCCGCAGCGGCCGAGCTGCGGCTACGTGCTGTGCACCGTGCTGCTGGCCCTGGCTGTGC
TGCTGGCTGTAGCTGTCACCGGTGCCGTGCTCTTCCTGAACCACGCCCACGCGCCGGGCACG
GCGCCCCACCTGTCGTCAGCACTGGGGCTGCCAGCGCCAACAGCGCCCTGGTCACTGTGGA
AAGGGCGGACAGCTCGCACCTCAGCATCCTCATTGACCCGCGCTGCCCCGACCTCACCGACA
GCTTCGCACGCCTGGAGAGCGCCCAGGCCTCGGTGCTGCAGGCGCTGACAGAGCACCAGGCC
CAGCCACGGCTGGTGGGCGACCAGGAGCAGGAGCTGCTGGACACGCTGGCCGACCAGCTGCC
CCGGCTGCTGGCCCGAGCCTCAGAGCTGCAGACGGAGTGCATGGGGCTGCGGAAGGGGCATG
GCACGCTGGGCCAGGGCCTCAGCGCCCTGCAGAGTGAGCAGGGCCGCCTCATCCAGCTTCTC
TCTGAGAGCCAGGGCCACATGGCTCACCTGGTGAACTCCGTCAGCGACATCCTGGATGCCCT
GCAGAGGGACCGGGGGCTGGGCCGGCCCCGCAACAAGGCCGACCTTCAGAGAGCGCCTGCCC
GGGGAACCCGGCCCCGGGGCTGTGCCACTGGCTCCCGGCCCCGAGACTGTCTGGACGTCCTC
CTAAGCGGACAGCAGGACGATGGCGTCTACTCTGTCTTTCCCACCCACTACCCGGCCGGCTT
CCAGGTGTACTGTGACATGCGCACGGACGGCGGCGGCTGGACGGTGTTTCAGCGCCGGGAGG
ACGGCTCCGTGAACTTCTTCCGGGGCTGGGACGCGTACCGAGACGGCTTTGGCAGGCTCACC
GGGGAGCACTGGCTAGGGCTCAAGAGGATCCACGCCCTGACCACACAGGCTGCCTACGAGCT
GCACGTGGACCTGGAGGACTTTGAGAATGGCACGGCCTATGCCCGCTACGGGAGCTTCGGCG
TGGGCTTGTTCTCCGTGGACCCTGAGGAAGACGGGTACCCGCTCACCGTGGCTGACTATTCC
GGCACTGCAGGCGACTCCCTCCTGAAGCACAGCGGCATGAGGTTCACCACCAAGGACCGTGA
CAGCGACCATTCAGAGAACAACTGTGCCGCCTTCTACCGCGGTGCCTGGTGGTACCGCAACT
GCCACACGTCCAACCTCAATGGGCAGTACCTGCGCGGTGCGCACGCCTCCTATGCCGACGGC
GTGGAGTGGTCCTCCTGGACCGGCTGGCAGTACTCACTCAAGTTCTCTGAGATGAAGATCCG
GCCGGTCCGGGAGGACCGCTAGACTGGTGCACCTTGTCCTTGGCCCTGCTGGTCCCTGTCGC
CCCATCCCCGACCCCACCTCACTCTTTCGTGAATGTTCTCCACCCACCTGTGCCTGGCGGAC
CCACTCTCCAGTAGGGAGGGGCCGGGCCATCCCTGACACGAAGCTCCCTGGGCCGGTGAAGT
CACACATCGCCTTCTCGCCGTCCCCACCCCCTCCATTTGGCAGCTCACTGATCTCTTGCCTC
TGCTGATGGGGGCTGGCAAACTTGACGACCCCAACTCCTGCCTGCCCCACTGTGACTCCGG
TGCTGTTTGCCGTCCCCTGGCCAGGATGGTGGAGTCTGCCCCAGGCACCCTCTGCCCTGCCC
GGCCAAATACCCGGCATTATGGGGACAGAGAGCAGGGGGCAGACAGCACCCCTGGAGTCCTC
CTAGCAGATCGTGGGGAATGTCAGGTCTCTCTGAGGTCAGGTCTGAGGCCAGTATCCTCCAG
CCCTCCCAATGCCAACCCCCACCCCGTTTCCCTGGTGCCCAGAGAACCCACCTCTCCCCCAA
GGGCCTCAGCCTGGCTGTGGGCTGGGTGGCCCCATCCTACCAGGCCCTGAGGTCAGGATGGG
GAGCTGCTGCCTTTGGGGACCCACGCTCCAAGGCTGAGACCAGTTCCCTGGAGGCCACCCAC
CCTGTGCCCCGGCAGGCCTGGGGTCTGCAGTCCTCTTACCTGCTGTGCCCACCTGCTCTCTG
TCTCAAATGAGGCCCAACCCATCCCCCACCCAGCTCCCGGCCGTCCTCCTACCTGGGGCAGC
CGGGGCTGCCATCCCATTTCTCCTGCCTCTGGAAGGTGGGTGGGGCCCTGCACCGTGGGGCT
GGACTGCGCTAATGGGAAGCTCTTGGTTTTCTGGGCTGGGGCCTAGGCAGGGCTGGGATGAG
GCTTGTACAACCCCCACCACCAATTTCCCAGGGACTCCAGGGTCCTGAGGCCTCCCAGGAGG
GCCTTGGGGGTGATGACCCCTTCCCTGAGGTGGCTGTCTCCATGAGGAGGCCAACCCTTGCC
ATTGACCGTGGCCACCTGGACCCAGGCCAGGCCCGGCCCGGCGAGTGGTCAAGGGACAGGGA
CCACCTCACCGGGCAAATGGGGTCGGGGGGACTGGGGCACCAGACCAGGCACCACCTGGACA
CTTTCTTGTTGAATCCTCCCAACACCCAGCACGCTGTCATCCCCACTCCTTGTGTGCACACA
TGCAGAGGTGAGACCCGCAGGCTCCCAGGACCAGCAGCCACAAGGGCAGGGCTGGAGCCGGG
TCCTCAGCTGTCTGCTCAGCAGCCCTGGACCCGCGTGCGTTACGTCAGGCCCAGATGCAGGG
CGGCTTTTCCAAGGCCTCCTGATGGGGCCTCCGAAAGGGCTGGAGTCAGCCTTGGGGAGCT
GCCTAGCAGCCTCTCCTCGGGCAGGAGGGGAGGTGGCTTCCTCCAAAGGACACCCGATGGCA
GGTGCCTAGGGGTGTGGGGTTCCGTTCTCCCTTCCCTCCCACTGAAGTTTGTGCTTAAAA
AACAATAAATTTGACTTGGCACCACTGGGGGTTGGTGGGAGAGGCCGTGTGACCTGGCTCTC
TGTCCCAGTGCCACCAGGTCATCCACATGCGCAG
```

FIGURE 228

MVNDRWKTMGGAAQLEDRPRDKPQRPSCGYVLCTVLLALAVLLAVAVTGAVLFLNHAHAPGT
APPPVVSTGAASANSALVTVERADSSHLSILIDPRCPDLTDSFARLESAQASVLQALTEHQA
QPRLVGDQEQELLDTLADQLPRLLARASELQTECMGLRKGHGTLGQGLSALQSEQGRLIQLL
SESQGHMAHLVNSVSDILDALQRDRGLGRPRNKADLQRAPARGTRPRGCATGSRPRDCLDVL
LSGQQDDGVYSVFPTHYPAGFQVYCDMRTDGGGWTVFQRREDGSVNFFRGWDAYRDGFGRLT
GEHWLGLKRIHALTTQAAYELHVDLEDFENGTAYARYGSFGVGLFSVDPEEDGYPLTVADYS
GTAGDSLLKHSGMRFTTKDRDSDHSENNCAAFYRGAWWYRNCHTSNLNGQYLRGAHASYADG
VEWSSWTGWQYSLKFSEMKIRPVREDR

FIGURE 229

GCAGTCAGAGACTTCCCCTGCCCCTCGCTGGGAAAGAACATTAGGAATGCCTTTTAGTGCCT
TGCTTCCTGAACTAGCTCACAGTAGCCCGGCGGCCCAGGGCAATCCGACCACATTTCACTCT
CACCGCTGTAGGAATCCAGATGCAGGCCAAGTACAGCAGCACGAGGGACATGCTGGATGATG
ATGGGGACACCACCATGAGCCTGCATTCTCAAGCCTCTGCCACAACTCGGCATCCAGAGCCC
CGGCGCACAGAGCACAGGGCTCCCTCTTCAACGTGGCGACCAGTGGCCCTGACCCTGCTGAC
TTTGTGCTTGGTGCTGCTGATAGGGCTGGCAGCCCTGGGGCTTTTGTTTTTTCAGTACTACC
AGCTCTCCAATACTGGTCAAGACACCATTTCTCAAATGGAAGAAAGATTAGGAAATACGTCC
CAAGAGTTGCAATCTCTTCAAGTCCAGAATATAAAGCTTGCAGGAAGTCTGCAGCATGTGGC
TGAAAAACTCTGTCGTGAGCTGTATAACAAAGCTGGAGCACACAGGTGCAGCCCTTGTACAG
AACAATGGAAATGGCATGGAGACAATTGCTACCAGTTCTATAAAGACAGCAAAAGTTGGGAG
GACTGTAAATATTTCTGCCTTAGTGAAAACTCTACCATGCTGAAGATAAACAAACAAGAAGA
CCTGGAATTTGCCGCGTCTCAGAGCTACTCTGAGTTTTTCTACTCTTATTGGACAGGGCTTT
TGCGCCCTGACAGTGGCAAGGCCTGGCTGTGGATGGATGGAACCCCTTTCACTTCTGAACTG
TTCCATATTATAATAGATGTCACCAGCCCAAGAAGCAGAGACTGTGTGGCCATCCTCAATGG
GATGATCTTCTCAAAGGACTGCAAAGAATTGAAGCGTTGTGTCTGTGAGAGAAGGGCAGGAA
TGGTGAAGCCAGAGAGCCTCCATGTCCCCCCTGAAACATTAGGCGAAGGTGACTGATTCGCC
CTCTGCAACTACAAATAGCAGAGTGAGCCAGGCGGTGCCAAAGCAAGGGCTAGTTGAGACAT
TGGGAAATGGAACATAATCAGGAAGACTATCTCTCTGACTAGTACAAAATGGGTTCTCGTG
TTTCCTGTTCAGGATCACCAGCATTTCTGAGCTTGGGTTTATGCACGTATTTAACAGTCACA
AGAAGTCTTATTTACATGCCACCAACCAACCTCAGAAACCCATAATGTCATCTGCCTTCTTG
GCTTAGAGATAACTTTTAGCTCTCTTTCTTCTCAATGTCTAATATCACCTCCCTGTTTTCAT
GTCTTCCTTACACTTGGTGGAATAAGAAACTTTTTGAAGTAGAGGAAATACATTGAGGTAAC
ATCCTTTTCTCTGACAGTCAAGTAGTCCATCAGAAATTGGCAGTCACTTCCCAGATTGTACC
AGCAAATACACAAGGAATTCTTTTTGTTTGTTTCAGTTCATACTAGTCCCTTCCCAATCCAT
CAGTAAAGACCCCATCTGCCTTGTCCATGCCGTTTCCCAACAGGGATGTCACTTGATATGAG
AATCTCAAATCTCAATGCCTTATAAGCATTCCTTCCTGTGTCCATTAAGACTCTGATAATTG
TCTCCCCTCCATAGGAATTTCTCCCAGGAAAGAAATATATCCCCATCTCCGTTTCATATCAG
AACTACCGTCCCCGATATTCCCTTCAGAGAGATTAAAGACCAGAAAAAGTGAGCCTCTTCA
TCTGCACCTGTAATAGTTTCAGTTCCTATTTTCTTCCATTGACCCATATTTATACCTTTCAG
GTACTGAAGATTTAATAATAATAAATGTAAATACTGTGAAAAA

FIGURE 230

MQAKYSSTRDMLDDDGDTTMSLHSQASATTRHPEPRRTEHRAPSSTWRPVALTLLTLCLVLL
IGLAALGLLFFQYYQLSNTGQDTISQMEERLGNTSQELQSLQVQNIKLAGSLQHVAEKLCRE
LYNKAGAHRCSPCTEQWKWHGDNCYQFYKDSKSWEDCKYFCLSENSTMLKINKQEDLEFAAS
QSYSEFFYSYWTGLLRPDSGKAWLWMDGTPFTSELFHIIIDVTSPRSRDCVAILNGMIFSKD
CKELKRCVCERRAGMVKPESLHVPPETLGEGD

FIGURE 231

AATTTTCACCGCTGTAGGAATCCAGATGCAGGCCAAGTACAGCAGCACGAGGGACATGNTGG
ATGATGATGGGACACCACCATGAGCCTGCATTNTCAAGCTTTTGCCACAATTCGGCATCCAG
AGCCCCGGCGCACAGAGCACAGGGNTCCTTTTTCAACGTGGCGACCAGTGGCCCTGACCCTG
CTGACTTTGTGCTTGGTGCTGCTGATAGGGCTGGCAGCCCTGGGGCTTTTGTTTTTTCAGTA
CTACCAGCTCTCCAATACTGGTCAAGACACCATTTCTCAAATGGAAGAAAGATTAGGAAATA
CGTCCCAAGAGTTGCAATTTNTTCAAGTCCAGAATATAAAGCTTGCAGGAAGTNTGCAGCAT
GTGGCTGAAAAACTCTGTCGTGAGCTGTATAACAAAGCTGGAGGAACTTTGAAGGAGGGCAA
AGTNTCCTCATNTACTATACACACCACTTCCC

FIGURE 232

```
GCCGAGCGCAAGAACCCTGCGCAGCCCAGAGCAGCTGCTGGAGGGGAATCGAGGCGCGGCTC
CGGGGATTCGGCTCGGGCCGCTGGCTCTGCTCTGCGGGGAGGGAGCGGGCCCGCCCGCGGGG
CCCGAGCCCTCCGGATCCGCCCCCTCCCCGGTCCCGCCCCCTCGGAGACTCCTCTGGCTGCT
CTGGGGGTTCGCCGGGGCCGGGGACCCGCGGTCCGGGCGCCATGCGGGCATCGCTGCTGCTG
TCGGTGCTGCGGCCCGCAGGGCCCGTGGCCGTGGGCATCTCCCTGGGCTTCACCCTGAGCCT
GCTCAGCGTCACCTGGGTGGAGGAGCCGTGCGGCCCAGGCCCGCCCCAACCTGGAGACTCTG
AGCTGCCGCCGCGCGGCAACACCAACGCGGCGCGCCGGCCCAACTCGGTGCAGCCCGGAGCG
GAGCGCGAGAAGCCCGGGGCCGGCGAAGGCGCCGGGGAGAATTGGGAGCCGCGCGTCTTGCC
CTACCACCCTGCACAGCCCGGCCAGGCCGCCAAAAAGGCCGTCAGGACCCGCTACATCAGCA
CGGAGCTGGGCATCAGGCAGAGGCTGCTGGTGGCGGTGCTGACCTCTCAGACCACGCTGCCC
ACGCTGGGCGTGGCCGTGAACCGCACGCTGGGGCACCGGCTGGAGCGTGTGGTGTTCCTGAC
GGGCGCACGGGGCCGCCGGGCCCCACCTGGCATGGCAGTGGTGACGCTGGGCGAGGAGCGAC
CCATTGGACACCTGCACCTGGCGCTGCGCCACCTGCTGGAGCAGCACGGCGACGACTTTGAC
TGGTTCTTCCTGGTGCCTGACACCACCTACACCGAGGCGCACGGCCTGGCACGCCTAACTGG
CCACCTCAGCCTGGCCTCCGCCGCCCACCTGTACCTGGGCCGGCCCCAGGACTTCATCGGCG
GAGAGCCCACCCCCGGCCGCTACTGCCACGGAGGCTTTGGGGTGCTGCTGTCGCGCATGCTG
CTGCAACAACTGCGCCCCCACCTGGAAGGCTGCCGCAACGACATCGTCAGTGCGCGCCCTGA
CGAGTGGCTGGGTCGCTGCATTCTCGATGCCACCGGGGTGGGCTGCACTGGTGACCACGAGG
GGGTGCACTATAGCCATCTGGAGCTGAGCCCTGGGGAGCCAGTGCAGGAGGGGGACCCTCAT
TTCCGAAGTGCCCTGACAGCCCACCCTGTGCGTGACCCTGTGCACATGTACCAGCTGCACAA
AGCTTTCGCCCGAGCTGAACTGGAACGCACGTACCAGGAGATCCAGGAGTTACAGTGGGAGA
TCCAGAATACCAGCCATCTGGCCGTTGATGGGGACCGGGCAGCTGCTTGGCCCGTGGGTATT
CCAGCACCATCCCGCCCGGCCTCCCGCTTTGAGGTGCTGCGCTGGGACTACTTCACGGAGCA
GCACGCTTTCTCCTGCGCCGATGGCTCACCCCGCTGCCCACTGCGTGGGGCTGACCGGGCTG
ATGTGGCCGATGTTCTGGGGACAGCTCTAGAGGAGCTGAACCGCCGCTACCACCCGGCCTTG
CGGCTCCAGAAGCAGCAGCTGGTGAATGGCTACCGACGCTTTGATCCGGCCCGGGGTATGGA
ATACACGCTGGACTTGCAGCTGGAGGCACTGACCCCCAGGGAGGCCGCCGGCCCCTCACTC
GCCGAGTGCAGCTGCTCCGGCCGCTGAGCCGCGTGGAGATCTTGCCTGTGCCCTATGTCACT
GAGGCCTCACGTCTCACTGTGCTGCTGCCTCTAGCTGCGGCTGAGCGTGACCTGGCCCCTGG
CTTCTTGGAGGCCTTTGCCACTGCAGCACTGGAGCCTGGTGATGCTGCGGCAGCCCTGACCC
TGCTGCTACTGTATGAGCCGCGCCAGGCCCAGCGCGTGGCCCATGCAGATGTCTTCGCACCT
GTCAAGGCCCACGTGGCAGAGCTGGAGCGGCGTTTCCCCGGTGCCCGGGTGCCATGGCTCAG
TGTGCAGACAGCCGCACCCTCACCACTGCGCCTCATGGATCTACTCTCCAAGAAGCACCCGC
TGGACACACTGTTCCTGCTGGCCGGGCAGACACGGTGCTCACGCCTGACTTCCTGAACCGC
TGCCGCATGCATGCCATCTCCGGCTGGCAGGCCTTCTTTCCCATGCATTTCCAAGCCTTCCA
CCCAGGTGTGGCCCCACCACAAGGGCCTGGGCCCCAGAGCTGGGCCGTGACACTGGCCGCT
TTGATCGCCAGGCAGCCAGCGAGGCCTGCTTCTACAACTCCGACTACGTGGCAGCCCGTGGG
CGCCTGGCGGCAGCCTCAGAACAAGAAGAGGAGCTGCTGGAGAGCCTGGATGTGTACGAGCT
GTTCCTCCACTTCTCCAGTCTGCATGTGCTGCGGGCGGTGGAGCCGGCGCTGCTGCAGCGCT
ACCGGGCCCAGACGTGCAGCGCGAGGCTCAGTGAGGACCTGTACCACCGCTGCCTCCAGAGC
GTGCTTGAGGGCCTCGGCTCCCGAACCCAGCTGGCCATGCTACTCTTTGAACAGGAGCAGGG
CAACAGCACCTGACCCCACCCTGTCCCCGTGGGCCGTGGCATGGCCACACCCCACCCCACTT
CTCCCCCAAAACCAGAGCCACCTGCCAGCCTCGCTGGGCAGGGCTGGCCGTAGCCAGACCCC
AAGCTGGCCCACTGGTCCCCTCTCTGGCTCTGTGGGTCCCTGGGCTCTGGACAAGCACTGGG
GGACGTGCCCCAGAGCCACCCACTTCTCATCCCAAACCCAGTTTCCCTGCCCCCTGACGCT
GCTGATTCGGGCTGTGGCCTCCACGTATTTATGCAGTACAGTCTGCCTGACGCCAGCCCTGC
CTCTGGGCCCTGGGGGCTGGGCTGTAGAAGAGTTGTTGGGGAAGGAGGGAGCTGAGGAGGGG
GCATCTCCCAACTTCTCCCTTTTGGACCCTGCCGAAGCTCCCTGCCTTTAATAAACTGGCCA
AGTGTGGAAAAA
```

FIGURE 233

MRASLLLSVLRPAGPVAVGISLGFTLSLLSVTWVEEPCGPGPPQPGDSELPPRGNTNAARRP
NSVQPGAEREKPGAGEGAGENWEPRVLPYHPAQPGQAAKKAVRTRYISTELGIRQRLLVAVL
TSQTTLPTLGVAVNRTLGHRLERVVFLTGARGRRAPPGMAVVTLGEERPIGHLHLALRHLLE
QHGDDFDWFFLVPDTTYTEAHGLARLTGHLSLASAAHLYLGRPQDFIGGEPTPGRYCHGGFG
VLLSRMLLQQLRPHLEGCRNDIVSARPDEWLGRCILDATGVGCTGDHEGVHYSHLELSPGEP
VQEGDPHFRSALTAHPVRDPVHMYQLHKAFARAELERTYQEIQELQWEIQNTSHLAVDGDRA
AAWPVGIPAPSRPASRFEVLRWDYFTEQHAFSCADGSPRCPLRGADRADVADVLGTALEELN
RRYHPALRLQKQQLVNGYRRFDPARGMEYTLDLQLEALTPQGGRRPLTRRVQLLRPLSRVEI
LPVPYVTEASRLTVLLPLAAAERDLAPGFLEAFATAALEPGDAAAALTLLLLYEPRQAQRVA
HADVFAPVKAHVAELERRFPGARVPWLSVQTAAPSPLRLMDLLSKKHPLDTLFLLAGPDTVL
TPDFLNRCRMHAISGWQAFFPMHFQAFHPGVAPPQGPGPPELGRDTGRFDRQAASEACFYNS
DYVAARGRLAAASEQEEELLESLDVYELFLHFSSLHVLRAVEPALLQRYRAQTCSARLSEDL
YHRCLQSVLEGLGSRTQLAMLLFEQEQGNST

FIGURE 234

```
GCTCTGGCCGGCCCCGGCGATTGGTCACCGCCCGCTAGGGGACAGCCCTGGCCTCCTCTGAT
TGGCAAGCGCTGGCCACCTCCCCACACCCCTTGCGAACGCTCCCCTAGTGGAGAAAAGGAGT
AGCTATTAGCCAATTCGGCAGGGCCCGCTTTTTAGAAGCTTGATTTCCTTTGAAGATGAAAG
ACTAGCGGAAGCTCTGCCTCTTTCCCCAGTGGGCGAGGGAACTCGGGGCGATTGGCTGGGAA
CTGTATCCACCCAAATGTCACCGATTTCTTCCTATGCAGGAAATGAGCAGACCCATCAATAA
GAAATTTCTCAGCCTGGCCGAAAATGGTTGGCCCCACGAAGCCACGACAACTGGAGGCAAAG
AGGGTTGCTCAACGCCCCGCCTCATTGGAAAACCAAATCAGATCTGGGACCTATATAGCGTG
GCGGAGGCGGGGCGATGATTGTCGCGCTCGCACCCACTGCAGCTGCGCACAGTCGCATTTCT
TTCCCCGCCCCTGAGACCCTGCAGCACCATCTGTCATGGCGGCTGGGCTGTTTGGTTTGAGC
GCTCGCCGTCTTTTGGCGGCAGCGGCGACGCGAGGGCTCCCGGCCGCCCGCGTCCGCTGGGA
ATCTAGCTTCTCCAGGACTGTGGTCGCCCCGTCCGCTGTGGCGGGAAAGCGGCCCCCAGAAC
CGACCACACCGTGGCAAGAGGACCCAGAACCCGAGGACGAAAACTTGTATGAGAAGAACCCA
GACTCCCATGGTTATGACAAGGACCCGTTTTGGACGTCTGGAACATGCGACTTGTCTTCTT
CTTTGGCGTCTCCATCATCCTGGTCCTTGGCAGCACCTTTGTGGCCTATCTGCCTGACTACA
GGATGAAAGAGTGGTCCCGCCGCGAAGCTGAGAGGCTTGTGAAATACCGAGAGGCCAATGGC
CTTCCCATCATGGAATCCAACTGCTTCGACCCCAGCAAGATCCAGCTGCCAGAGGATGAGTG
ACCAGTTGCTAAGTGGGGCTCAAGAAGCACCGCCTTCCCCACCCCTGCCTGCCATTCTGAC
CTCTTCTCAGAGCACCTAATTAAAGGGGCTGAAAGTCTGAA
```

FIGURE 235

MAAGLFGLSARRLLAAAATRGLPAARVRWESSFSRTVVAPSAVAGKRPPEPTTPWQEDPEPE
DENLYEKNPDSHGYDKDPVLDVWNMRLVFFFGVSIILVLGSTFVAYLPDYRMKEWSRREAER
LVKYREANGLPIMESNCFDPSKIQLPEDE

FIGURE 236

GGCGGCTGGGCTGTTTGGTTTGAGCGCTCGCCGTCTTTTGGCGGCAGCGGCGACGCGAGGGC
TCCCGGCCGCCCGCGTCCGCTGGGAATCTAGCTTCTCCAGGACTGTGGTCGCCCCGTCCGCT
GTGGCGGGAAAGCGGCCCCAGAACCGACCACACCGTGGCAAGAGGACCCAGAACCCGAGGA
CGAAAACTTGTATGAGAAGAACCCAGACTCCATGGTTATGACAAGGACCCCGTTTTGGACG
TCTGGAACATGCGACTTGTCTTCTTCTTTGGCGTCTCCATCATCCTGGTCCTTGGCAGCACC
TTTGTGGCCTATCTGCCTGACTACAGGATGAAAGAGTGGTCCCGCCGCGAAGCTGAGAGGCT
TGTGAAATACCGAGAGGCCAATGGCCTTCCCATCATGGAATCCAACTGCTTCGACCCCAGCA
AGATCCAG

FIGURE 237

GCGGCGGCTATGCCGCTTGCTCTGCTCGTCCTGTTGCTCCTGGGGCCCGGCGGCTGGTGCCT
TGCAGAACCCCCACGCGACAGCCTGCGGGAGGAACTTGTCATCACCCCGCTGCCTTCCGGGG
ACGTAGCCGCCACATTCCAGTTCCGCACGCGCTGGGATTCGGAGCTTCAGCGGGAAGGAGTG
TCCCATTACAGGCTCTTTCCCAAAGCCCTGGGGCAGCTGATCTCCAAGTATTCTCTACGGGA
GCTGCACCTGTCATTCACACAAGGCTTTTGGAGGACCCGATACTGGGGGCCACCCTTCCTGC
AGGCCCCATCAGGTGCAGAGCTGTGGGTCTGGTTCCAAGACACTGTCACTGATGTGGATAAA
TCTTGGAAGGAGCTCAGTAATGTCCTCTCAGGGATCTTCTGCGCCTCTCTCAACTTCATCGA
CTCCACCAACACAGTCACTCCCACTGCCTCCTTCAAACCCCTGGGTCTGGCCAATGACACTG
ACCACTACTTTCTGCGCTATGCTGTGCTGCCGCGGGAGGTGGTCTGCACCGAAAACCTCACC
CCCTGGAAGAAGCTCTTGCCCTGTAGTTCCAAGGCAGGCCTCTCTGTGCTGCTGAAGGCAGA
TCGCTTGTTCCACACCAGCTACCACTCCCAGGCAGTGCATATCCGCCTGTTTGCAGAAATG
CACGCTGTACTAGCATCTCCTGGGAGCTGAGGCAGACCCTGTCAGTTGTATTTGATGCCTTC
ATCACGGGGCAGGGAAAGAAAGACTGGTCCCTCTTCCGGATGTTCTCCCGAACCCTCACGGA
GCCCTGCCCCTGGCTTCAGAGAGCCGAGTCTATGTGGACATCACCACCTACAACCAGGACA
ACGAGACATTAGAGGTGCACCCACCCCGACCACTACATATCAGGACGTCATCCTAGGCACT
CGGAAGACCTATGCCATCTATGACTTGCTTGACACCGCCATGATCAACAACTCTCGAAACCT
CAACATCCAGCTCAAGTGGAAGAGACCCCAGAGAATGAGGCCCCCCAGTGCCCTTCCTGC
ATGCCCAGCGGTACGTGAGTGGCTATGGGCTGCAGAAGGGGGAGCTGAGCACACTGCTGTAC
AACACCCACCCATACCGGGCCTTCCCGGTGCTGCTGCTGGACACCGTACCCTGGTATCTGCG
GCTGTATGTGCACACCCTCACCATCACCTCCAAGGGCAAGGAGAACAAACCAAGTTACATCC
ACTACCAGCCTGCCCAGGACCGGCTGCAACCCCACCTCCTGGAGATGCTGATTCAGCTGCCG
GCCAACTCAGTCACCAAGGTTTCCATCCAGTTTGAGCGGGCGCTGCTGAAGTGGACCGAGTA
CACGCCAGATCCTAACCATGGCTTCTATGTCAGCCCATCTGTCCTCAGCGCCCTTGTGCCCA
GCATGGTAGCAGCCAAGCCAGTGGACTGGGAAGAGAGTCCCCTCTTCAACAGCCTGTTCCCA
GTCTCTGATGGCTCTAACTACTTTGTGCGGCTCTACACGGAGCCGCTGCTGGTGAACCTGCC
GACACCGGACTTCAGCATGCCCTACAACGTGATCTGCCTCACGTGCACTGTGGTGGCCGTGT
GCTACGGCTCCTTCTACAATCTCCTCACCCGAACCTTCCACATCGAGGAGCCCCGCACAGGT
GGCCTGGCCAAGCGGCTGGCCAACCTTATCCGGCGCGCCCGAGGTGTCCCCCACTCTGATT
CTTGCCCTTTCCAGCAGCTGCAGCTGCCGTTTCTCTCTGGGGAGGGGAGCCCAAGGGCTGTT
TCTGCCACTTGCTCTCCTCAGAGTTGGCTTTTGAACCAAAGTGCCCTGGACCAGGTCAGGGC
CTACAGCTGTGTTGTCCAGTACAGGAGCCACGAGCCAAATGTGGCATTTGAATTTGAATTAA
CTTAGAAATTCATTTCCTCACCTGTAGTGGCCACCTCTATATTGAGGTGCTCAATAAGCAAA
AGTGGTCGGTGGCTGCTGTATTGGACAGCACAGAAAAGATTTCCATCACCACAGAAAGGTC
GGCTGGCAGCACTGGCCAAGGTGATGGGGTGTGCTACACAGTGTATGTCACTGTGTAGTGGA
TGGAGTTTACTGTTTGTGGAATAAAAACGGCTGTTTCCGTGGAAAAAAAAAAA

FIGURE 238

MPLALLVLLLLGPGGWCLAEPPRDSLREELVITPLPSGDVAATFQFRTRWDSELQREGVSHY
RLFPKALGQLISKYSLRELHLSFTQGFWRTRYWGPPFLQAPSGAELWVWFQDTVTDVDKSWK
ELSNVLSGIFCASLNFIDSTNTVTPTASFKPLGLANDTDHYFLRYAVLPREVVCTENLTPWK
KLLPCSSKAGLSVLLKADRLFHTSYHSQAVHIRPVCRNARCTSISWELRQTLSVVFDAFITG
QGKKDWSLFRMFSRTLTEPCPLASESRVYVDITTYNQDNETLEVHPPPTTTYQDVILGTRKT
YAIYDLLDTAMINNSRNLNIQLKWKRPPENEAPPVPFLHAQRYVSGYGLQKGELSTLLYNTH
PYRAFPVLLLDTVPWYLRLYVHTLTITSKGKENKPSYIHYQPAQDRLQPHLLEMLIQLPANS
VTKVSIQFERALLKWTEYTPDPNHGFYVSPSVLSALVPSMVAAKPVDWEESPLFNSLFPVSD
GSNYFVRLYTEPLLVNLPTPDFSMPYNVICLTCTVVAVCYGSFYNLLTRTFHIEEPRTGGLA
KRLANLIRRARGVPPL

FIGURE 239

CAACATGGGGTCCAGCAGCTTCTTGGTCCTCATGGTGTCTCTCGTTCTTGTGACCCTGGTGG
CTGTGGAAGGAGTTAAAGAGGGTATAGAGAAAGCAGGGGTTTGCCCAGCTGACAACGTACGC
TGCTTCAAGTCCGATCCTCCCCAGTGTCACACAGACCAGGACTGTCTGGGGGAAAGGAAGTG
TTGTTACCTGCACTGTGGCTTCAAGTGTGTGATTCCTGTGAAGGAACTGGAAGAAGGAGGAA
ACAAGGATGAAGATGTGTCAAGGCCATACCCTGAGCCAGGATGGGAGGCCAAGTGTCCAGGC
TCCTCCTCTACCAGGTGTCCTCAGAAATGATGCTGGGTCCTTTCTACCTCTGGGGTCACTC
TCACTTGGCACCTGCCCCTGAGGGTCCTGAGACTTGGAATATGGAAGAAGCAATACCCAACC
CCACCAAAGAAACCTGAGCTTGAAGTCCTTTTCCCCAAAAGAGGGAAGAGTCACAAAAAG
TCCAGACCCCAGGGACGGTACTTTCCCTCTCTACCTGGTGCTCCTCCCTAATGCTCATGAAT
GGACCCCTCATGAATGAAACCAGTGCCCTTATAAGAGACCCCAAAGAGCTGCCTTGCCCTTC
TGCAATGTGTGATCACAGCTAGAAGGCACTGTCAGAGAAGAGAAACTGGTCCTCACCAGATG
CTGAATCTGCTGGTGCCTTGATCTTGGACTTCCCAGCCTCTAGAACTGTAAGAAATAAATAT
TTGCTGTTTATAATCCAA

FIGURE 240

MGSSSFLVLMVSLVLVTLVAVEGVKEGIEKAGVCPADNVRCFKSDPPQCHTDQDCLGERKCC
YLHCGFKCVIPVKELEEGGNKDEDVSRPYPEPGWEAKCPGSSSTRCPQK

Signal sequence:

amino acids 1-19

N-myristoylation sites:

amino acids 23-29, 27-33, 32-38, 102-108

WAP-type 'four-disulfide core' domain signature:

amino acids 49-63

FIGURE 241

```
AAACTCAGCACTTGCCGGAGTGGCTCATTGTTAAGACAAAGGGTGTGCACTTCCTGGCCAGG
AAACCTGAGCGGTGAGACTCCCAGCTGCCTACATCAAGGCCCCAGGACATGCAGAACCTTCC
TCTAGAACCCGACCCACCACCATGAGGTCCTGCCTGTGGAGATGCAGGCACCTGAGCCAAGG
CGTCCAGTGGTCCTTGCTTCTGGCTGTCCTGGTCTTCTTTCTCTTCGCCTTGCCCTCTTTTA
TTAAGGAGCCTCAAACAAAGCCTTCCAGGCATCAACGCACAGAGAACATTAAAGAAAGGTCT
CTACAGTCCCTGGCAAAGCCTAAGTCCCAGGCACCCACAAGGGCGAGGAGGACAACCATCTA
TGCAGAGCCAGCGCCAGAGAACAATGCCCTCAACACACAAACCCAGCCCAAGGCCCACACCA
CCGGAGACAGAGGAAAGGAGGCCAACCAGGCACCGCCGGAGGAGCAGGACAAGGTGCCCCAC
ACAGCACAGAGGGCAGCATGGAAGAGCCCAGAAAAGAGAAAACCATGGTGAACACACTGTC
ACCCAGAGGGCAAGATGCAGGGATGGCCTCTGGCAGGACAGAGGCACAATCATGGAAGAGCC
AGGACACAAAGACGACCCAAGGAAATGGGGGCCAGACCAGGAAGCTGACGGCCTCCAGGACG
GTGTCAGAGAAGCACCAGGGCAAAGCGGCAACCACAGCCAAGACGCTCATTCCCAAAAGTCA
GCACAGAATGCTGGCTCCCACAGGAGCAGTGTCAACAAGGACGAGACAGAAAGGAGTGACCA
CAGCAGTCATCCCACCTAAGGAGAAGAAACCTCAGGCCACCCCACCCCCTGCCCCTTTCCAG
AGCCCCACGACGCAGAGAAACCAAAGACTGAAGGCCGCCAACTTCAAATCTGAGCCTCGGTG
GGATTTTGAGGAAAAATACAGCTTCGAAATAGGAGGCCTTCAGACGACTTGCCCTGACTCTG
TGAAGATCAAAGCCTCCAAGTCGCTGTGGCTCCAGAAACTCTTTCTGCCCAACCTCACTCTC
TTCCTGGACTCCAGACACTTCAACCAGAGTGAGTGGGACCGCCTGGAACACTTTGCACCACC
CTTTGGCTTCATGGAGCTCAACTACTCCTTGGTGCAGAAGGTCGTGACACGCTTCCCTCCAG
TGCCCCAGCAGCAGCTGCTCCTGGCCAGCCTCCCCGCTGGGAGCCTCCGGTGCATCACCTGT
GCCGTGGTGGGCAACGGGGGCATCCTGAACAACTCCCACATGGGCCAGGAGATAGACAGTCA
CGACTACGTGTTCCGATTGAGCGGAGCTCTCATTAAAGGCTACAACAGGATGTGGGGACTC
GGACATCCTTCTACGGCTTTACCGCCTTCTCCCTGACCCAGTCACTCCTTATATTGGGCAAT
CGGGGTTTCAAGAACGTGCCTCTTGGGAAGGACGTCCGCTACTTGCACTTCCTGGAAGGCAC
CCGGGACTATGAGTGGCTGGAAGCACTGCTTATGAATCAGACGGTGATGTCAAAAAACCTTT
TCTGGTTCAGGCACAGACCCCAGGAAGCTTTTCGGGAAGCCCTGCACATGGACAGGTACCTG
TTGCTGCACCCAGACTTTCTCCGATACATGAAGAACAGGTTTCTGAGGTCTAAGACCCTGGA
TGGTGCCCACTGGAGGATATACCGCCCCACCACTGGGGCCCTCCTGCTGCTCACTGCCCTTC
AGCTCTGTGACCAGGTGAGTGCTTATGGCTTCATCACTGAGGGCCATGAGCGCTTTTCTGAT
CACTACTATGATACATCATGGAAGCGGCTGATCTTTTACATAAACCATGACTTCAAGCTGGA
GAGAGAAGTCTGGAAGCGGCTACACGATGAAGGGATAATCCGGCTGTACCAGCGTCCTGGTC
CCGGAACTGCCAAAGCCAAGAACTGACCGGGGCCAGGGCTGCCATGGTCTCCTTGCCTGCTC
CAAGGCACAGGATACAGTGGGAATCTTGAGACTCTTTGGCCATTTCCCATGGCTCAGACTAA
GCTCCAAGCCCTTCAGGAGTTCCAAGGGAACACTTGAACCATGGACAAGACTCTCTCAAGAT
GGCAAATGGCTAATTGAGGTTCTGAAGTTCTTCAGTACATTGCTGTAGGTCCTGAGGCCAGG
GATTTTTAATTAAATGGGGTGATGGGTGGCCAATACCACAATTCCTGCTGAAAAACACTCTT
CCAGTCCAAAGCTTCTTGATACAGAAAAAGAGCCTGGATTTACAGAAACATATAGATCTG
GTTTGAATTCCAGATCGAGTTTACAGTTGTGAAATCTTGAAGGTATTACTTAACTTCACTAC
AGATTGTCTAGAAGACCTTTCTAGGAGTTATCTGATTCTAGAAGGGTCTATACTTGTCCTTG
TCTTTAAGCTATTTGACAACTCTACGTGTTGTAGAAAACTGATAATAATACAAATGATTGTT
GTCCATGGAAAGGCAAATAAATTTTCTACAGTGAAAAAAAAAAAAAA
```

FIGURE 242

MRSCLWRCRHLSQGVQWSLLLAVLVFFLFALPSFIKEPQTKPSRHQRTENIKERSLQSLAKP
KSQAPTRARRTTIYAEPAPENNALNTQTQPKAHTTGDRGKEANQAPPEEQDKVPHTAQRAAW
KSPEKEKTMVNTLSPRGQDAGMASGRTEAQSWKSQDTKTTQGNGGQTRKLTASRTVSEKHQG
KAATTAKTLIPKSQHRMLAPTGAVSTRTRQKGVTTAVIPPKEKKPQATPPPAPFQSPTTQRN
QRLKAANFKSEPRWDFEEKYSFEIGGLQTTCPDSVKIKASKSLWLQKLFLPNLTLFLDSRHF
NQSEWDRLEHFAPPFGFMELNYSLVQKVVTRFPPVPQQQLLLASLPAGSLRCITCAVVGNGG
ILNNSHMGQEIDSHDYVFRLSGALIKGYEQDVGTRTSFYGFTAFSLTQSLLILGNRGFKNVP
LGKDVRYLHFLEGTRDYEWLEALLMNQTVMSKNLFWFRHRPQEAFREALHMDRYLLLHPDFL
RYMKNRFLRSKTLDGAHWRIYRPTTGALLLLTALQLCDQVSAYGFITEGHERFSDHYYDTSW
KRLIFYINHDFKLEREVWKRLHDEGIIRLYQRPGPGTAKAKN

Cytoplasmic Domain:

amino acids 1-10

Type II Transmembrane Domain:

amino acids 11-35

Lumenal catalytic Domain:

amino acids 36-600

Ribonucleotide Reductase small subunit Signature:

amino acids 481-496

N-glycosylation Sites:

amino acids 300-303, 311-314, 331-334, 375-378, 460-463

FIGURE 243

CGATGCGCGGACCCGGGCACCCCCTCCTCCTGGGGCTGCTGCTGGTGCTGGGGCCTTCGCCG
GAGCAGCGAGTGGAAATTGTTCCTCGAGATCTGAGGATGAAGGACAAGTTTCTAAAACACCT
TACAGGCCCTCTTTATTTTAGTCCAAAGTGCAGCAAACACTTCCATAGACTTTATCACAACA
CCAGAGACTGCACCATTCCTGCATACTATAAAAGATGCGCCAGGCTTCTTACCCGGCTGGCT
GTCAGTCCAGTGTGCATGGAGGATAAGTGAGCAGACCGTACAGGAGCAGCACACCAGGAGCC
ATGAGAAGTGCCTTGGAAACCAACAGGGAAACAGAACTATCTTTATACACATCCCCTCATGG
ACAAGAGATTTATTTTTGCAGACAGACTCTTCCATAAGTCCTTTGAGTTTTGTATGTTGTTG
ACAGTTTGCAGATATATATTCGATAAATCAGTGTACTTGACAGTGTTATCTGTCACTTATTT

FIGURE 244

MRGPGHPLLLGLLLVLGPSPEQRVEIVPRDLRMKDKFLKHLTGPLYFSPKCSKHFHRLYHNT
RDCTIPAYYKRCARLLTRLAVSPVCMEDK

FIGURE 245

GGGCTGGGCCCCGCCGCAGCTCCAGCTGGCCGGCTTGGTCCTGCGGTCCCTTCTCTGGGAGG
CCCGACCCCGGCCGCGCCCAGCCCCCACCATGCCACCCGCGGGGCTCCGCCGGGCCGCGCCG
CTCACCGCAATCGCTCTGTTGGTGCTGGGGGCTCCCCTGGTGCTGGCCGGCGAGGACTGCCT
GTGGTACCTGGACCGGAATGGCTCCTGGCATCCGGGGTTTAACTGCGAGTTCTTCACCTTCT
GCTGCGGGACCTGCTACCATCGGTACTGCTGCAGGGACCTGACCTTGCTTATCACCGAGAGG
CAGCAGAAGCACTGCCTGGCCTTCAGCCCCAAGACCATAGCAGGCATCGCCTCAGCTGTGAT
CCTCTTTGTTGCTGTGGTTGCCACCACCATCTGCTGCTTCCTCTGTTCCTGTTGCTACCTGT
ACCGCCGGCGCCAGCAGCTCCAGAGCCCATTTGAAGGCCAGGAGATTCCAATGACAGGCATC
CCAGTGCAGCCAGTATACCCATACCCCCAGGACCCCAAAGCTGGCCCTGCACCCCACAGCC
TGGCTTCATGTACCCACCTAGTGGTCCTGCTCCCCAATATCCACTCTACCCAGCTGGGCCCC
CAGTCTACAACCCTGCAGCTCCTCCTCCCTATATGCCACCACAGCCCTCTTACCCGGGAGCC
TGAGGAACCAGCCATGTCTCTGCTGCCCCTTCAGTGATGCCAACCTTGGGAGATGCCCTCAT
CCTGTACCTGCATCTGGTCCTGGGGGTGGCAGGAGTCCTCCAGCCACCAGGCCCCAGACCAA
GCCAAGCCCTGGGCCCTACTGGGGACAGAGCCCCAGGGAAGTGGAACAGGAGCTGAACTAGA
ACTATGAGGGGTTGGGGGGAGGGCTTGGAATTATGGGCTATTTTTACTGGGGGCAAGGGAGG
GAGATGACAGCCTGGGTCACAGTGCCTGTTTTCAAATAGTCCCTCTGCTCCCAAGATCCCAG
CCAGGAAGGCTGGGGCCCTACTGTTTGTCCCCTCTGGGCTGGGGTGGGGGGAGGCAGGAGGT
TCCGTCAGCAGCTGGCAGTAGCCCTCCTCTCTGGCTGCCCACTGGCCACATCTCTGGCCTG
CTAGATTAAAGCTGTAAAGACAAAA

FIGURE 246

MPPAGLRRAAPLTAIALLVLGAPLVLAGEDCLWYLDRNGSWHPGFNCEFFTFCCGTCYHRYC
CRDLTLLITERQQKHCLAFSPKTIAGIASAVILFVAVVATTICCFLCSCCYLYRRRQQLQSP
FEGQEIPMTGIPVQPVYPYPQDPKAGPAPPQPGFMYPPSGPAPQYPLYPAGPPVYNPAAPPP
YMPPQPSYPGA

Transmembrane Domains:

amino acids 10-28, 85-110

N-glycosylation Site:

amino acids 38-41

N-myristoylation Sites:

amino acids 5-10, 88-93

FIGURE 247

```
GGGGGAGCTAGGCCGGCGGCAGTGGTGGTGGCGGCGGCGCAAGGGTGAGGGCGGCCCCAGAA
CCCCAGGTAGGTAGAGCAAGAAGATGGTGTTTCTGCCCCTCAAATGGTCCCTTGCAACCATG
TCATTTCTACTTTCCTCACTGTTGGCTCTCTTAACTGTGTCCACTCCTTCATGGTGTCAGAG
CACTGAAGCATCTCCAAAACGTAGTGATGGACACCATTTCCTTGGAATAAAATACGACTTC
CTGAGTACGTCATCCCAGTTCATTATGATCTCTTGATCCATGCAAACCTTACCACGCTGACC
TTCTGGGGAACCACGAAAGTAGAAATCACAGCCAGTCAGCCCACCAGCACCATCATCCTGCA
TAGTCACCACCTGCAGATATCTAGGGCCACCCTCAGGAAGGGAGCTGGAGAGAGGCTATCGG
AAGAACCCCTGCAGGTCCTGGAACACCCCCTCAGGAGCAAATTGCACTGCTGGCTCCCGAG
CCCCTCCTTGTCGGGCTCCCGTACACAGTTGTCATTCACTATGCTGGCAATCTTTCGGAGAC
TTTCCACGGATTTTACAAAAGCACCTACAGAACCAAGGAAGGGGAACTGAGGATACTAGCAT
CAACACAATTTGAACCCACTGCAGCTAGAATGGCCTTTCCCTGCTTTGATGAACCTGCCTTC
AAAGCAAGTTTCTCAATCAAAATTAGAAGAGAGCCAAGGCACCTAGCCATCTCCAATATGCC
ATTGGTGAAATCTGTGACTGTTGCTGAAGGACTCATAGAAGACCATTTTGATGTCACTGTGA
AGATGAGCACCTATCTGGTGGCCTTCATCATTTCAGATTTTGAGTCTGTCAGCAAGATAACC
AAGAGTGGAGTCAAGGTTTCTGTTTATGCTGTGCCAGACAAGATAAATCAAGCAGATTATGC
ACTGGATGCTGCGGTGACTCTTCTAGAATTTTATGAGGATTATTTCAGCATACCGTATCCCC
TACCCAAACAAGATCTTGCTGCTATTCCCGACTTTCAGTCTGGTGCTATGGAAAACTGGGGA
CTGACAACATATAGAGAATCTGCTCTGTTGTTTGATGCAGAAAAGTCTTCTGCATCAAGTAA
GCTTGGCATCACAGTGACTGTGGCCCATGAACTGGCCCACCAGTGGTTTGGGAACCTGGTCA
CTATGGAATGGTGGAATGATCTTTGGCTAAATGAAGGATTTGCCAAATTTATGGAGTTTGTG
TCTGTCAGTGTGACCCATCCTGAACTGAAAGTTGGAGATTATTTCTTTGGCAAATGTTTTGA
CGCAATGGAGGTAGATGCTTTAAATTCCTCACACCCTGTGTCTACACCTGTGGAAAATCCTG
CTCAGATCCGGGAGATGTTTGATGATGTTTCTTATGATAAGGGAGCTTGTATTCTGAATATG
CTAAGGGAGTATCTTAGCGCTGACGCATTTAAAAGTGGTATTGTACAGTATCTCCAGAAGCA
TAGCTATAAAAATACAAAAAACGAGGACCTGTGGGATAGTATGGCAAGTATTTGCCCTACAG
ATGGTGTAAAAGGGATGGATGGCTTTTGCTCTAGAAGTCAACATTCATCTTCATCCTCACAT
TGGCATCAGGAAGGGGTGGATGTGAAAACCATGATGAACACTTGGACACTGCAGAGGGGTTT
TCCCCTAATAACCATCACAGTGAGGGGGAGGAATGTACACATGAAGCAAGAGCACTACATGA
AGGGCTCTGACGGCGCCCCGGACACTGGGTACCTGTGGCATGTTCCATTGACATTCATCACC
AGCAAATCCAACATGGTCCATCGATTTTTGCTAAAAACAAAAACAGATGTGCTCATCCTCCC
AGAAGAGGTGGAATGGATCAAATTTAATGTGGGCATGAATGGCTATTACATTGTGCATTACG
AGGATGATGGATGGACTCTTTGACTGGCCTTTTAAAAGGAACACACACAGCAGTCAGCAGT
AATGATCGGGCAAGTCTCATTAACAATGCATTTCAGCTCGTCAGCATTGGGAAGCTGTCCAT
TGAAAAGGCCTTGGATTTATCCCTGTACTTGAAACATGAAACTGAATTATGCCCGTGTTTC
AAGGTTTGAATGAGCTGATTCCTATGTATAAGTTAATGGAGAAAAGAGATATGAATGAAGTG
GAAACTCAATTCAAGGCCTTCCTCATCAGGCTGCTAAGGGACCTCATTGATAAGCAGACATG
GACAGACGAGGGCTCAGTCTCAGAGCAAATGCTGCGGAGTGAACTACTACTCCTCGCCTGTG
TGCACAACTATCAGCCGTGCGTACAGAGGGCAGAAGGCTATTTCAGAAAGTGGAAGGAATCC
AATGGAAACTTGAGCCTGCCTGTCGACGTGACCTTGGCAGTGTTTGCTGTGGGGCCCAGAG
CACAGAAGGCTGGGATTTTCTTTATAGTAAATATCAGTTTTCTTTGTCCAGTACTGAGAAAA
GCCAAATTGAATTTGCCCTCTGCAGAACCCAAAATAAGGAAAAGCTTCAATGGCTACTAGAT
GAAAGCTTTAAGGGAGATAAAATAAAAACTCAGGAGTTTCCACAAATTCTTACACTCATTGG
CAGGAACCCAGTAGGATACCCACTGGCCTGGCAATTTCTGAGGAAAACTGGAACAAACTTG
TACAAAAGTTTGAACTTGGCTCATCTTCCATAGCCCACATGGTAATGGGTACAACAAATCAA
TTCTCCACAAGAACACGGCTTGAAGAGGTAAAAGGATTCTTCAGCTCTTTGAAAGAAATGG
TTCTCAGCTCCGTTGTGTCCAACAGACAATTGAAACCATTGAAGAAACATCGGTTGGATGG
ATAAGAATTTTGATAAAATCAGAGTGTGGCTGCAAAGTGAAAGCTTGAACGTATGTAAAAA
TTCCTCCCTTGCCCGGTTCCTGTTATCTCTAATCACCAACATTTTGTTGAGTGTATTTTCAA
ACTAGAGATGGCTGTTTTGGCTCCAACTGGAGATACTTTTTCCCTTCAACTCATTTTTGA
CTATCCCTGTGAAAAGAATAGCTGTTAGTTTTTCATGAATGGGCTTTTTCATGAATGGGCTA
TCGCTACCATGTGTTTTGTTCATCACAGGTGTTGCCCTGCAACGTAAACCCAAGTGTTGGGT
TCCCTGCCACAGAAGAATAAAGTACCTTATTCTTCTCAAAAAAAAAAAAAAAAAAAAAAAAA
```

FIGURE 248

```
MVFLPLKWSLATMSFLLSSLLALLTVSTPSWCQSTEASPKRSDGTPFPWNKIRLPEYVIPVH
YDLLIHANLTTLTFWGTTKVEITASQPTSTIILHSHHLQISRATLRKGAGERLSEEPLQVLE
HPPQEQIALLAPEPLLVGLPYTVVIHYAGNLSETFHGFYKSTYRTKEGELRILASTQFEPTA
ARMAFPCFDEPAFKASFSIKIRREPRHLAISNMPLVKSVTVAEGLIEDHFDVTVKMSTYLVA
FIISDFESVSKITKSGVKVSVYAVPDKINQADYALDAAVTLLEFYEDYFSIPYPLPKQDLAA
IPDFQSGAMENWGLTTYRESALLFDAEKSSASSKLGITVTVAHELAHQWFGNLVTMEWWNDL
WLNEGFAKFMEFVSVSVTHPELKVGDYFFGKCFDAMEVDALNSSHPVSTPVENPAQIREMFD
DVSYDKGACILNMLREYLSADAFKSGIVQYLQKHSYKNTKNEDLWDSMASICPTDGVKGMDG
FCSRSQHSSSSSHWHQEGVDVKTMMNTWTLQRGFPLITITVRGRNVHMKQEHYMKGSDGAPD
TGYLWHVPLTFITSKSNMVHRFLLKTKTDVLILPEEVEWIKFNVGMNGYYIVHYEDDGWDSL
TGLLKGTHTAVSSNDRASLINNAFQLVSIGKLSIEKALDLSLYLKHETEIMPVFQGLNELIP
MYKLMEKRDMNEVETQFKAFLIRLLRDLIDKQTWTDEGSVSEQMLRSELLLLACVHNYQPCV
QRAEGYFRKWKESNGNLSLPVDVTLAVFAVGAQSTEGWDFLYSKYQFSLSSTEKSQIEFALC
RTQNKEKLQWLLDESFKGDKIKTQEFPQILTLIGRNPVGYPLAWQFLRKNWNKLVQKFELGS
SSIAHMVMGTTNQFSTRTRLEEVKGFFSSLKENGSQLRCVQQTIETIEENIGWMDKNFDKIR
VWLQSEKLERM
```

Signal peptide:
amino acids 1-34

N-glycosylation sites:
amino acids 70-74, 154-158, 414-418, 760-764, 901-905

Neutral zinc metallopeptidases, zinc-binding region signature:
amino acids 350-360

FIGURE 249

CAGCCACAGACGGGTCATGAGCGCGGTATTACTGCTGGCCCTCCTGGGGTTCATCCTCCCAC
TGCCAGGAGTGCAGGCGCTGCTCTGCCAGTTTGGGACAGTTCAGCATGTGTGGAAGGTGTCC
GACCTACCCCGGCAATGGACCCCTAAGAACACCAGCTGCGACAGCGGCTTGGGGTGCCAGGA
CACGTTGATGCTCATTGAGAGCGGACCCCAAGTGAGCCTGGTGCTCTCCAAGGGCTGCACGG
AGGCCAAGGACCAGGAGCCCCGCGTCACTGAGCACCGGATGGGCCCCGGCCTCTCCCTGATC
TCCTACACCTTCGTGTGCCGCCAGGAGGACTTCTGCAACAACCTCGTTAACTCCCTCCCGCT
TTGGGCCCCACAGCCCCCAGCAGACCCAGGATCCTTGAGGTGCCCAGTCTGCTTGTCTATGG
AAGGCTGTCTGGAGGGGACAACAGAAGAGATCTGCCCCAAGGGGACCACACACTGTTATGAT
GGCCTCCTCAGGCTCAGGGGAGGAGGCATCTTCTCCAATCTGAGAGTCCAGGGATGCATGCC
CCAGCCAGGTTGCAACCTGCTCAATGGGACACAGGAAATTGGGCCCGTGGGTATGACTGAGA
ACTGCAATAGGAAAGATTTTCTGACCTGTCATCGGGGACCACCATTATGACACACGGAAAC
TTGGCTCAAGAACCCACTGATTGGACCACATCGAATACCGAGATGTGCGAGGTGGGGCAGGT
GTGTCAGGAGACGCTGCTGCTCATAGATGTAGGACTCACATCAACCCTGGTGGGGACAAAAG
GCTGCAGCACTGTTGGGGCTCAAAATTCCCAGAAGACCACCATCCACTCAGCCCCTCCTGGG
GTGCTTGTGGCCTCCTATACCCACTTCTGCTCCTCGGACCTGTGCAATAGTGCCAGCAGCAG
CAGCGTTCTGCTGAACTCCCTCCCTCCTCAAGCTGCCCCTGTCCCAGGAGACCGGCAGTGTC
CTACCTGTGTGCAGCCCCTTGGAACCTGTTCAAGTGGCTCCCCCCGAATGACCTGCCCCAGG
GGCGCCACTCATTGTTATGATGGGTACATTCATCTCTCAGGAGGTGGGCTGTCCACCAAAAT
GAGCATTCAGGGCTGCGTGGCCCAACCTTCCAGCTTCTTGTTGAACCACACCAGACAAATCG
GGATCTTCTCTGCGCGTGAGAAGCGTGATGTGCAGCCTCCTGCCTCTCAGCATGAGGGAGGT
GGGGCTGAGGGCCTGGAGTCTCTCACTTGGGGGGTGGGGCTGGCACTGGCCCCAGCGCTGTG
GTGGGGAGTGGTTTGCCCTTCCTGCTAACTCTATTACCCCACGATTCTTCACCGCTGCTGA
CCACCCACACTCAACCTCCCTCTGACCTCATAACCTAATGGCCTTGGACACCAGATTCTTTC
CCATTCTGTCCATGAATCATCTTCCCCACACACAATCATTCATATCTACTCACCTAACAGCA
ACACTGGGGAGAGCCTGGAGCATCCGGACTTGCCCTATGGGAGAGGGGACGCTGGAGGAGTG
GCTGCATGTATCTGATAATACAGACCCTGTCCTTTCA

FIGURE 250

MSAVLLLALLGFILPLPGVQALLCQFGTVQHVWKVSDLPRQWTPKNTSCDSGLGCQDTLMLI
ESGPQVSLVLSKGCTEAKDQEPRVTEHRMGPGLSLISYTFVCRQEDFCNNLVNSLPLWAPQP
PADPGSLRCPVCLSMEGCLEGTTEEICPKGTTHCYDGLLRLRGGGIFSNLRVQGCMPQPGCN
LLNGTQEIGPVGMTENCNRKDFLTCHRGTTIMTHGNLAQEPTDWTTSNTEMCEVGQVCQETL
LLIDVGLTSTLVGTKGCSTVGAQNSQKTTIHSAPPGVLVASYTHFCSSDLCNSASSSSVLLN
SLPPQAAPVPGDRQCPTCVQPLGTCSSGSPRMTCPRGATHCYDGYIHLSGGGLSTKMSIQGC
VAQPSSFLLNHTRQIGIFSAREKRDVQPPASQHEGGGAEGLESLTWGVGLALAPALWWGVVC
PSC

FIGURE 251

```
GCGACGGGCAGGACGCCCCGTTCGCCTAGCGCGTGCTCAGGAGTTGGTGTCCTGCCTGCGCT
CAGGATGAGGGGGAATCTGGCCCTGGTGGGCGTTCTAATCAGCCTGGCCTTCCTGTCACTGCTG
CCATCTGGACATCCTCAGCCGGCTGGCGATGACGCCTGCTCTGTGCAGATCCTCGTCCCTGG
CCTCAAAGGGGATGCGGGAGAGAAGGGAGACAAAGGCGCCCCGGACGGCCTGGAAGAGTCG
GCCCCACGGGAGAAAAGGAGACATGGGGGACAAAGGACAGAAAGGCAGTGTGGGTCGTCAT
GGAAAAATTGGTCCCATTGGCTCTAAAGGTGAGAAAGGAGATTCCGGTGACATAGGACCCCC
TGGTCCTAATGGAGAACCAGGCCTCCCATGTGAGTGCAGCCAGCTGCGCAAGGCCATCGGGG
AGATGGACAACCAGGTCTCTCAGCTGACCAGCGAGCTCAAGTTCATCAAGAATGCTGTCGCC
GGTGTGCGCGAGACGGAGAGCAAGATCTACCTGCTGGTGAAGGAGGAGAAGCGCTACGCGGA
CGCCCAGCTGTCCTGCCAGGGCCGCGGGGCACGCTGAGCATGCCCAAGGACGAGGCTGCCA
ATGGCCTGATGGCCGCATACCTGGCGCAAGCCGGCCTGGCCCGTGTCTTCATCGGCATCAAC
GACCTGGAGAAGGAGGGCGCCTTCGTGTACTCTGACCACTCCCCCATGCGGACCTTCAACAA
GTGGCGCAGCGGTGAGCCCAACAATGCCTACGACGAGGAGGACTGCGTGGAGATGGTGGCCT
CGGGCGGCTGGAACGACGTGGCCTGCCACACCACCATGTACTTCATGTGTGAGTTTGACAAG
GAGAACATGTGAGCCTCAGGCTGGGGCTGCCCATTGGGGGCCCCACATGTCCCTGCAGGGTT
GGCAGGGACAGAGCCCAGACCATGGTGCCAGCCAGGGAGCTGTCCCTCTGTGAAGGGTGGAG
GCTCACTGAGTAGAGGGCTGTTGTCTAAACTGAGAAAATGGCCTATGCTTAAGAGGAAAATG
AAAGTGTTCCTGGGGTGCTGTCTCTGAAGAAGCAGAGTTTCATTACCTGTATTGTAGCCCCA
ATGTCATTATGTAATTATTACCCAGAATTGCTCTTCCATAAAGCTTGTGCCTTTGTCCAAGC
TATACAATAAAATCTTTAAGTAGTGCAGTAGTTAAGTCCAAAAAAAAAAAAAAAAAAA
```

FIGURE 252

MRGNLALVGVLISLAFLSLLPSGHPQPAGDDACSVQILVPGLKGDAGEKGDKGAPGRPGRVG
PTGEKGDMGDKGQKGSVGRHGKIGPIGSKGEKGDSGDIGPPGPNGEPGLPCECSQLRKAIGE
MDNQVSQLTSELKFIKNAVAGVRETESKIYLLVKEEKRYADAQLSCQGRGGTLSMPKDEAAN
GLMAAYLAQAGLARVFIGINDLEKEGAFVYSDHSPMRTFNKWRSGEPNNAYDEEDCVEMVAS
GGWNDVACHTTMYFMCEFDKENM

FIGURE 253

AGTGACTGCAGCCTTCCTAGATCCCCTCCACTCGGTTTCTCTCTTTGCAGGAGCACCGGCAG
CACCAGTGTGTGAGGGGAGCAGGCAGCGGTCCTAGCCAGTTCCTTGATCCTGCCAGACCACC
CAGCCCCCGGCACAGAGCTGCTCCACAGGCACCATGAGGATCATGCTGCTATTCACAGCCAT
CCTGGCCTTCAGCCTAGCTCAGAGCTTTGGGGCTGTCTGTAAGGAGCCACAGGAGGAGGTGG
TTCCTGGCGGGGCCGCAGCAAGAGGGATCCAGATCTCTACCAGCTGCTCCAGAGACTCTTC
AAAAGCCACTCATCTCTGGAGGGATTGCTCAAAGCCCTGAGCCAGGCTAGCACAGATCCTAA
GGAATCAACATCTCCCGAGAAACGTGACATGCATGACTTCTTTGTGGGACTTATGGGCAAGA
GGAGCGTCCAGCCAGAGGGAAAGACAGGACCTTTCTTACCTTCAGTGAGGGTTCCTCGGCCC
CTTCATCCCAATCAGCTTGGATCCACAGGAAGTCTTCCCTGGGAACAGAGGAGCAGAGACC
TTTATAAGACTCTCCTACGGATGTGAATCAAGAGAACGTCCCCAGCTTTGGCATCCTCAAGT
ATCCCCGAGAGCAGAATAGGTACTCCACTTCCGGACTCCTGGACTGCATTAGGAAGACCTC
TTTCCCTGTCCCAATCCCCAGGTGCGCACGCTCCTGTTACCCTTTCTCTTCCCTGTTCTTGT
AACATTCTTGTGCTTTGACTCCTTCTCCATCTTTTCTACCTGACCCTGGTGTGGAAACTGCA
TAGTGAATATCCCCAACCCCAATGGGCATTGACTGTAGAATACCCTAGAGTTCCTGTAGTGT
CCTACATTAAAAATATAATGTCTCTCTCTATTCCTCAACAATAAAGGATTTTTGCATATGAA
AAAAAAAAAAAAAAAAAAAAAAAAAAAAAAAAAAAA

FIGURE 254

MRIMLLFTAILAFSLAQSFGAVCKEPQEEVVPGGGRSKRDPDLYQLLQRLFKSHSSLEGLLK
ALSQASTDPKESTSPEKRDMHDFFVGLMGKRSVQPEGKTGPFLPSVRVPRPLHPNQLGSTGK
SSLGTEEQRPL

Important features:

Signal peptide:

amino acids 1-18

Tyrosine kinase phosphorylation site.

amino acids 36-45

N-myristoylation site.

amino acids 33-39, 59-65

Amidation site.

amino acids 90-94

Leucine zipper pattern.

amino acids 43-65

Tachykinin family signature.

amino acids 86-92

FIGURE 255

```
GGGCGTCTCCGGCTGCTCCTATTGAGCTGTCTGCTCGCTGTGCCCGCTGTGCCTGCTGTGCC
CGCGCTGTCGCCGCTGCTACCGCGTCTGCTGGACGCGGGAGACGCCAGCGAGCTGGTGATTG
GAGCCCTGCGGAGAGCTCAAGCGCCCAGCTCTGCCCCAGGAGCCCAGGCTGCCCCGTGAGTC
CCATAGTTGCTGCAGGAGTGGAGCCATGAGCTGCGTCCTGGGTGGTGTCATCCCCTTGGGGC
TGCTGTTCCTGGTCTGCGGATCCCAAGGCTACCTCCTGCCCAACGTCACTCTCTTAGAGGAG
CTGCTCAGCAAATACCAGCACAACGAGTCTCACTCCCGGGTCCGCAGAGCCATCCCCAGGGA
GGACAAGGAGGAGATCCTCATGCTGCACAACAAGCTTCGGGCCAGGTGCAGCCTCAGGCCT
CCAACATGGAGTACATGGTGAGCGCCGGCTCCGGCCGCAGAGGCTGGCACCGGGGTGGGGC
CTGGGCCACCAGCCTGCTCTGTTCCCCAGCCAGCTCTGTTCCCCAGCCAGTGCGTGTGATGG
CTGGCTCAGGGTCTCCTCTGGCAGGGGAGGATCCCGGCTCTGTTCTGTTTTGTTTGTTTGTT
TTGAGACAGGGTCTCACTCTGCCACTGACGCTGGAGTGCAATGGCACAATCGTCATGCCCTG
AAACCTTAGACTCCCGGGGTTAAGCGATCCTGCTTCAGCCTCCCAAGTAGCTGGAACTACAG
GCATGCACCATGGTGCCCAGCTAGATTTTAAATATTTTGTGGAGATGGGGGTCTTGCTACGT
TGCCCAGGCTGGTCTTGAACTCCTAGGCTCAAGCAATCCTCCTGCCTCAGCCTCTCAAAGTG
CTAGGATTATAGGCATGAGTCACCCTGTCTGGCTCTGGCTCTGTTCTTAACATTCTGCCAAA
ACAACACACGTGGGTTCCCTGTGCAGAGCCTGCCTCGTTGCCTTCATGTCACTCTTGGTAGC
TCCACTGGGAACACAGCTCTCAGCCTTTCCCACCTGGAGGCAGAGTGGGGAGGGGCCCAGGG
CTGGGCTTTGCTGATGCTGATCTCAGCTGTGCCACACGCTAGCTGCACCACCCTGACTTCTC
CTTAGCCCGTGTGAGCCTCACTTTCCACTTGGAGAGTCCTTCCTCGCGTGGTTGCCATGACT
GTGAGATAAGTCGAGGCTGTGAAGGGCCCGGCACAGACTGACCTGCCTCCCCAACCCCTAGG
CTTTGCTAACCGGGAAAGGAGCTAACGGTGACAGAAGACAGCCAAGGTCAACCCTCCCGGGT
GATTGTGATGGGTGTTCCAGGTGTGGTTGGGCGATGCTGCTACTTGACCCCAAGCTCCAGTG
TGGAAACTTCCTTCCTGGCTGGTTTTCCAGAACTACAGAGGAATGGACCACAGTCTTCCAGG
GTCCCTCCTCGTCCACCAACCGGGAGCCTCCACCTTGGCCATCCGTCAGCTATGAATGGCTT
TTTAAACAAACCCACGTCCCAGCCTGGGTAACATGGTAAAGCCCCGTCTCTACAAAAAAATC
CAAGTTAGCCGGGCATGGTGGTGCGCACCTGTAGTCCCAGCTGCAGTGGGACTGAGGTGGAG
GTGGAGGTGGGGGGTGGGAGCTGAGGAAGGAGGATCGCTTGAGCCTGGGAAGTCGAGGCTGC
AGTGAGCTGAGATTGCACCACTGCACTCCAGCCTGGGTGACAGAGCAAGACCCTGTCTCAAAAA
```

FIGURE 256

MSCVLGGVIPLGLLFLVCGSQGYLLPNVTLLEELLSKYQHNESHSRVRRAIPREDKEEILML
HNKLRGQVQPQASNMEYMVSAGSGRRGWHRGWGLGHQPALFPSQLCSPASACDGWLRVSSGR
GGSRLCSVLFVCFETGSHSATDAGVQWHNRHALKP

Important features:

Signal peptide:

amino acids 1-22

N-glycosylation site.

amino acids 27-31, 41-45

N-myristoylation site.

amino acids 126-132, 140-146

Amidation site.

amino acids 85-89

FIGURE 257

AAGGAGAGGCCACCGGGACTTCAGTGTCTCCTCCATCCCAGGAGCGCAGTGGCCACTATGGG
GTCTGGGCTGCCCCTTGTCCTCCTCTTGACCCTCCTTGGCAGCTCACATGGAACAGGGCCGG
GTATGACTTTGCAACTGAAGCTGAAGGAGTCTTTTCTGACAAATTCCTCCTATGAGTCCAGC
TTCCTGGAATTGCTTGAAAAGCTCTGCCTCCTCCTCCATCTCCCTTCAGGGACCAGCGTCAC
CCTCCACCATGCAAGATCTCAACACCATGTTGTCTGCAACACATGACAGCCATTGAAGCCTG
TGTCCTTCTTGGCCCGGGCTTTTGGGCCGGGGATGCAGGAGGCAGGCCCCGACCCTGTCTTT
CAGCAGGCCCCACCCTCCTGAGTGGCAATAAATAAAATTCGGTATGCTG

FIGURE 258

MGSGLPLVLLLTLLGSSHGTGPGMTLQLKLKESFLTNSSYESSFLELLEKLCLLLHLPSGTS
VTLHHARSQHHVVCNT

FIGURE 259

AATTGTATCTGTGTAATGTTAAAACAAACGAAATAAAATAGAAGGAAAAACTTTCTGAGTTT
CAAAAACAACAGACTAGTACTCTAAAGAACTCTTTAAAACAATTAACTGTTAGGATTGCAGT
TATGATTGGATATTATTTAATTCTGTTTCTGATGTGGGGTTCCTCCACTGTGTTCTGTGTGC
TATTAATATTTACCATTGCAGAAGCTTCATTCAGTGTTGAAAATGAATGCTTAGTGGATCTG
TGCCTCTTACGCATATGTTACAAATTATCTGGAGTTCCTAATCAATGCAGAGTTCCCCTCCC
CTCCGATTGTTCTAAATAATTGAAAGATGTCTGCTGTGGAAAAGGCATGTATTTAAATCTG
TATGATTCTCAACCATCTTTAGTTGGGAAAGGTCCTTGAAAGCCAATGGAAATACTTTTTTT
TTTTCTTGGCACTAATCAAGTGAGTGTTACCTTTTCACTTAGTAGGATGTGTTGTTACGCTA
GTAAAATAGAAACCTGTGTTTATTCTCAGGTATTTTAGAAACAACAGCCATCATTTTATTTT
ATGTGTGTGTTCTTGGCTGTATTCATAAATTATATATTTTGGGCTATCAAATATTACTTCAT
TCAATATAAATAACAATAGTAGAAGTTGTTTACTTAGATATGCTTTCTAGTTGCATTTTCTC
AGCCTATGTAAGACTACTTTGTTGTAATAGCCTTTGAAATTTACAGTACTGTCTCTCTACTA
TCTTCAGATTACTTGATTCAAATAAACCAATTATGTTTGTAATTGATATTAATAAACCAGA
ATAAAAGTTCATATCTACCC

FIGURE 260

MIGYYLILFLMWGSSTVFCVLLIFTIAEASFSVENECLVDLCLLRICYKLSGVPNQCRVPLP
SDCSK

Important features:

Signal peptide:

amino acids 1-29

FIGURE 261

```
GAGGATTTGCCACAGCAGCGGATAGAGCAGGAGAGCACCACCGGAGCCCTTGAGACATCCTT
GAGAAGAGCCACAGCATAAGAGACTGCCCTGCTTGGTGTTTTGCAGGATGATGGTGGCCCTT
CGAGGAGCTTCTGCATTGCTGGTTCTGTTCCTTGCAGCTTTTCTGCCCCCGCCGCAGTGTAC
CCAGGACCCAGCCATGGTGCATTACATCTACCAGCGCTTTCGAGTCTTGGAGCAAGGGCTGG
AAAAATGTACCCAAGCAACGAGGGCATACATTCAAGAATTCCAAGAGTTCTCAAAAATATA
TCTGTCATGCTGGGAAGATGTCAGACCTACACAAGTGAGTACAAGAGTGCAGTGGGTAACTT
GGCACTGAGAGTTGAACGTGCCCAACGGGAGATTGACTACATACAATACCTTCGAGAGGCTG
ACGAGTGCATCGTATCAGAGGACAAGACACTGGCAGAAATGTTGCTCCAAGAAGCTGAAGAA
GAGAAAAAGATCCGGACTCTGCTGAATGCAAGCTGTGACAACATGCTGATGGGCATAAAGTC
TTTGAAAATAGTGAAGAAGATGATGGACACACATGGCTCTTGGATGAAAGATGCTGTCTATA
ACTCTCCAAAGGTGTACTTATTAATTGGATCCAGAAACAACACTGTTTGGGAATTTGCAAAC
ATACGGGCATTCATGGAGGATAACACCAAGCCAGCTCCCGGAAGCAAATCCTAACACTTTC
CTGGCAGGGAACAGGCCAAGTGATCTACAAAGGTTTTCTATTTTTTCATAACCAAGCAACTT
CTAATGAGATAATCAAATATAACCTGCAGAAGAGGACTGTGGAAGATCGAATGCTGCTCCCA
GGAGGGTAGGCCGAGCATTGGTTTACCAGCACTCCCCCTCAACTTACATTGACCTGGCTGT
GGATGAGCATGGGCTCTGGGCCATCCACTCTGGGCCAGGCACCCATAGCCATTTGGTTCTCA
CAAAGATTGAGCCGGGCACACTGGGAGTGGAGCATTCATGGGATACCCCATGCAGAAGCCAG
GATGCTGAAGCCTCATTCCTCTTGTGTGGGGTTCTCTATGTGGTCTACAGTACTGGGGGCCA
GGGCCCTCATCGCATCACCTGCATCTATGATCCACTGGGCACTATCAGTGAGGAGGACTTGC
CCAACTTGTTCTTCCCCAAGAGACCAAGAAGTCACTCCATGATCCATTACAACCCCAGAGAT
AAGCAGCTCTATGCCTGGAATGAAGGAAACCAGATCATTTACAAACTCCAGACAAAGAGAAA
GCTGCCTCTGAAGTAATGCATTACAGCTGTGAGAAGAGCACTGTGGCTTTGGCAGCTGTTC
TACAGGACAGTGAGGCTATAGCCCCTTCACAATATAGTATCCCTCTAATCACACACAGGAAG
AGTGTGTAGAAGTGGAAATACGTATGCCTCCTTTCCCAAATGTCACTGCCTTAGGTATCTTC
CAAGAGCTTAGATGAGAGCATATCATCAGGAAAGTTTCAACAATGTCCATTACTCCCCAAA
CCTCCTGGCTCTCAAGGATGACCACATTCTGATACAGCCTACTTCAAGCCTTTTGTTTACT
GCTCCCCAGCATTTACTGTAACTCTGCCATCTTCCCTCCCACAATTAGAGTTGTATGCCAGC
CCCTAATATTCACCACTGGCTTTTCTCTCCCTGGCCTTTGCTGAAGCTCTTCCCTCTTTTT
CAAATGTCTATTGATATTCTCCCATTTTCACTGCCCAACTAAAATACTATTAATATTTCTTT
CTTTTCTTTTCTTTTTTTGAGACAAGGTCTCACTATGTTGCCCAGGCTGGTCTCAAACTCC
AGAGCTCAAGAGATCCTCCTGCCTCAGCCTCCTAAGTACCTGGGATTACAGGCATGTGCCAC
CACACCTGGCTTAAAATACTATTTCTTATTGAGGTTTAACCTCTATTTCCCCTAGCCCTGTC
CTTCCACTAAGCTTGGTAGATGTAATAATAAAGTGAAAATATTAACATTTGAATATCGCTTT
CCAGGTGTGGAGTGTTTGCACATCATTGAATTCTCGTTTCACCTTTGTGAAACATGCACAAG
TCTTTACAGCTGTCATTCTAGAGTTTAGGTGAGTAACACAATTACAAAGTGAAAGATACAGC
TAGAAAATACTACAAATCCCATAGTTTTTCCATTGCCCAAGGAAGCATCAAATACGTATGTT
TGTTCACCTACTCTTATAGTCAATGCGTTCATCGTTTCAGCCTAAAAATAATAGTCTGTCCC
TTTAGCCAGTTTTCATGTCTGCACAAGACCTTTCAATAGGCCTTTCAAATGATAATTCCTCC
AGAAAACCAGTCTAAGGGTGAGGACCCCAACTCTAGCCTCCTCTTGTCTTGCTGTCCTCTGT
TTCTCTCTTTCTGCTTTAAATTCAATAAAAGTGACACTGAGCAAAAAAAAAAAAAA
```

FIGURE 262

MMVALRGASALLVLFLAAFLPPPQCTQDPAMVHYIYQRFRVLEQGLEKCTQATRAYIQEFQE
FSKNISVMLGRCQTYTSEYKSAVGNLALRVERAQREIDYIQYLREADECIVSEDKTLAEMLL
QEAEEEKKIRTLLNASCDNMLMGIKSLKIVKKMMDTHGSWMKDAVYNSPKVYLLIGSRNNTV
WEFANIRAFMEDNTKPAPRKQILTLSWQGTGQVIYKGFLFFHNQATSNEIIKYNLQKRTVED
RMLLPGGVGRALVYQHSPSTYIDLAVDEHGLWAIHSGPGTHSHLVLTKIEPGTLGVEHSWDT
PCRSQDAEASFLLCGVLYVVYSTGGQGPHRITCIYDPLGTISEEDLPNLFFPKRPRSHSMIH
YNPRDKQLYAWNEGNQIIYKLQTKRKLPLK

FIGURE 263

```
GGGCGCCCGCGTACTCACTAGCTGAGGTGGCAGTGGTTCCACCAACATGGAGCTCTCGCAGA
TGTCGGAGCTCATGGGGCTGTCGGTGTTGCTTGGGCTGCTGGCCCTGATGGCGACGGCGGCG
GTAGCGCGGGGGTGGCTGCGCGCGGGGGAGGAGAGGAGCGGCCGGCCCGCCTGCCAAAAAGC
AAATGGATTTCCACCTGACAAATCTTCGGGATCCAAGAAGCAGAAACAATATCAGCGGATTC
GGAAGGAGAAGCCTCAACAACACAACTTCACCCACCGCCTCCTGGCTGCAGCTCTGAAGAGC
CACAGCGGGAACATATCTTGCATGGACTTTAGCAGCAATGGCAAATACCTGGCTACCTGTGC
AGATGATCGCACCATCCGCATCTGGAGCACCAAGGACTTCCTGCAGCGAGAGCACCGCAGCA
TGAGAGCCAACGTGGAGCTGGACCACGCCACCCTGGTGCGCTTCAGCCCTGACTGCAGAGCC
TTCATCGTCTGGCTGGCCAACGGGGACACCCTCCGTGTCTTCAAGATGACCAAGCGGGAGGA
TGGGGGCTACACCTTCACAGCCACCCCAGAGGACTTCCCTAAAAAGCACAAGGCGCCTGTCA
TCGACATTGGCATTGCTAACACAGGGAAGTTTATCATGACTGCCTCCAGTGACACCACTGTC
CTCATCTGGAGCCTGAAGGGTCAAGTGCTGTCTACCATCAACACCAACCAGATGAACAACAC
ACACGCTGCTGTATCTCCCTGTGGCAGATTTGTAGCCTCGTGTGGCTTCACCCCAGATGTGA
AGGTTTGGGAAGTCTGCTTTGGAAAGAAGGGGGAGTTCCAGGAGGTGGTGCGAGCCTTCGAA
CTAAAGGGCCACTCCGCGGCTGTGCACTCGTTTGCTTTCTCCAACGACTCACGGAGGATGGC
TTCTGTCTCCAAGGATGGTACATGGAAACTGTGGACACAGATGTGGAATACAAGAAGAAGC
AGGACCCCTACTTGCTGAAGACAGGCCGCTTTGAAGAGGCGGCGGGTGCCGCGCCGTGCCGC
CTGGCCCTCTCCCCCAACGCCCAGGTCTTGGCCTTGGCCAGTGGCAGTAGTATTCATCTCTA
CAATACCCGGCGGGGCGAGAAGGAGGAGTGCTTTGAGCGGGTCCATGGCGAGTGTATCGCCA
ACTTGTCCTTTGACATCACTGGCCGCTTTCTGGCCTCCTGTGGGGACCGGGCGGTGCGGCTG
TTTCACAACACTCCTGGCCACCGAGCCATGGTGGAGGAGATGCAGGGCCACCTGAAGCGGGC
CTCCAACGAGAGCACCCGCCAGAGGCTGCAGCAGCAGCTGACCCAGGCCAAGAGACCCTGA
AGAGCCTGGGTGCCCTGAAGAAGTGACTCTGGGAGGGCCCGGCGCAGAGGATTGAGGAGGAG
GGATCTGGCCTCCTCATGGCACTGCTGCCATCTTTCCTCCCAGGTGGAAGCCTTTCAGAAGG
AGTCTCCTGGTTTTCTTACTGGTGGCCCTGCTTCTTCCCATTGAAACTACTCTTGTCTACTT
AGGTCTCTCTCTTCTTGCTGGCTGTGACTCCTCCCTGACTAGTGGCCAAGGTGCTTTTCTTC
CTCCCAGGCCCAGTGGGTGGAATCTGTCCCCACCTGGCACTGAGGAGAATGGTAGAGAGGAG
AGCAGAGAGAGAGAGAATGTGATTTTTGGCCTTGTGGCAGCACATCCTCACACCCAAAGAAG
TTTGTAAATGTTCCAGAACAACCTAGAGAACACCTGAGTACTAAGCAGCAGTTTTGCAAGGA
TGGGAGACTGGGATAGCTTCCCATCACAGAACTGTGTTCCATCAAAAAGACACTAAGGGATT
TCCTTCTGGGCCTCAGTTCTATTTGTAAGATGGAGAATAATCCTCTCTGTGAACTCCTTGCA
AAGATGATATGAGGCTAAGAGAATATCAAGTCCCCAGGTCTGGAAGAAAAGTAGAAAGAGT
AGTACTATTGTCCAATGTCATGAAAGTGGTAAAAGTGGGAACCAGTGTGCTTTGAAACCAAA
TTAGAAACACATTCCTTGGGAAGGCAAAGTTTTCTGGGACTTGATCATACATTTTATATGGT
TGGGACTTCTCTCTTCGGGAGATGATATCTTGTTTAAGGAGACCTCTTTTCAGTTCATCAAG
TTCATCAGATATTTGAGTGCCCACTCTGTGCCCAAATAAATATGAGCTGGGGATTAAAAAAA
AAAAAAAAAAAAAAAAAAAAAAAAAAAAAAAAAAAAAAAAAAAAAAAA
```

FIGURE 264

MELSQMSELMGLSVLLGLLALMATAAVARGWLRAGEERSGRPACQKANGFPPDKSSGSKKQK
QYQRIRKEKPQQHNFTHRLLAAALKSHSGNISCMDFSSNGKYLATCADDRTIRIWSTKDFLQ
REHRSMRANVELDHATLVRFSPDCRAFIVWLANGDTLRVFKMTKREDGGYTFTATPEDFPKK
HKAPVIDIGIANTGKFIMTASSDTTVLIWSLKGQVLSTINTNQMNNTHAAVSPCGRFVASCG
FTPDVKVWEVCFGKKGEFQEVVRAFELKGHSAAVHSFAFSNDSRRMASVSKDGTWKLWDTDV
EYKKKQDPYLLKTGRFEEAAGAAPCRLALSPNAQVLALASGSSIHLYNTRRGEKEECFERVH
GECIANLSFDITGRFLASCGDRAVRLFHNTPGHRAMVEEMQGHLKRASNESTRQRLQQQLTQ
AQETLKSLGALKK

Important features:
Signal peptide:
amino acids 1-25

N-glycosylation site.
amino acids 76-80, 92-96, 231-235, 289-293, 378-382, 421-425

Beta-transducin family Trp-Asp repeat protein.
amino acids 30-47, 105-118, 107-119, 203-216, 205-217, 296-308

FIGURE 265

TGGCCTCCCCAGCTTGCCAGGCACAAGGCTGAGCGGGAGGAAGCGAGAGGCATCTAAGCAGG
CAGTGTTTTGCCTTCACCCCAAGTGACCATGAGAGGTGCCACGCGAGTCTCAATCATGCTCC
TCCTAGTAACTGTGTCTGACTGTGCTGTGATCACAGGGGCCTGTGAGCGGGATGTCCAGTGT
GGGGCAGGCACCTGCTGTGCCATCAGCCTGTGGCTTCGAGGGCTGCGGATGTGCACCCCGCT
GGGGCGGGAAGGCGAGGAGTGCCACCCCGGCAGCCACAAGGTCCCCTTCTTCAGGAAACGCA
AGCACCACACCTGTCCTTGCTTGCCCAACCTGCTGTGCTCCAGGTTCCCGGACGGCAGGTAC
CGCTGCTCCATGGACTTGAAGAACATCAATTTTTAGGCGCTTGCCTGGTCTCAGGATACCCA
CCATCCTTTTCCTGAGCACAGCCTGGATTTTTATTTCTGCCATGAAACCCAGCTCCCATGAC
TCTCCCAGTCCCTACACTGACTACCCTGATCTCTCTTGTCTAGTACGCACATATGCACACAG
GCAGACATACCTCCCATCATGACATGGTCCCCAGGCTGGCCTGAGGATGTCACAGCTTGAGG
CTGTGGTGTGAAAGGTGGCCAGCCTGGTTCTCTTCCCTGCTCAGGCTGCCAGAGAGGTGGTA
AATGGCAGAAAGGACATTCCCCCTCCCCTCCCCAGGTGACCTGCTCTCTTTCCTGGGCCCTG
CCCCTCTCCCCACATGTATCCCTCGGTCTGAATTAGACATTCCTGGGCACAGGCTCTTGGGT
GCATTGCTCAGAGTCCCAGGTCCTGGCCTGACCCTCAGGCCCTTCACGTGAGGTCTGTGAGG
ACCAATTTGTGGGTAGTTCATCTTCCCTCGATTGGTTAACTCCTTAGTTTCAGACCACAGAC
TCAAGATTGGCTCTTCCCAGAGGGCAGCAGACAGTCACCCCAAGGCAGGTGTAGGGAGCCCA
GGGAGGCCAATCAGCCCCCTGAAGACTCTGGTCCCAGTCAGCCTGTGGCTTGTGGCCTGTGA
CCTGTGACCTTCTGCCAGAATTGTCATGCCTCTGAGGCCCCCTCTTACCACACTTTACCAGT
TAACCACTGAAGCCCCCAATTCCCACAGCTTTTCCATTAAAATGCAAATGGTGGTGGTTCAA
TCTAATCTGATATTGACATATTAGAAGGCAATTAGGGTGTTTCCTTAAACAACTCCTTTCCA
AGGATCAGCCCTGAGAGCAGGTTGGTGACTTTGAGGAGGGCAGTCCTCTGTCCAGATTGGGG
TGGGAGCAAGGGACAGGGAGCAGGGCAGGGCTGAAGGGGCACTGATTCAGACCAGGGAGG
CAACTACACACCAACATGCTGGCTTTAGAATAAAAGCACCAACTGAAAAAA

FIGURE 266

MRGATRVSIMLLLVTVSDCAVITGACERDVQCGAGTCCAISLWLRGLRMCTPLGREGEECHP
GSHKVPFFRKRKHHTCPCLPNLLCSRFPDGRYRCSMDLKNINF

Signal peptide:

amino acids 1-19

Tyrosine kinase phosphorylation site:

amino acids 88-95

N-myristoylation sites:

amino acids 33-39, 35-41, 46-52

FIGURE 267

```
AGCGCCCGGGCGTCGGGGCGGTAAAAGGCCGGCAGAAGGGAGGCACTTGAGAAATGTCTTTC
CTCCAGGACCCAAGTTTCTTCACCATGGGGATGTGGTCCATTGGTGCAGGAGCCCTGGGGGC
TGCTGCCTTGGCATTGCTGCTTGCCAACACAGACGTGTTTCTGTCCAAGCCCCAGAAAGCGG
CCCTGGAGTACCTGGAGGATATAGACCTGAAAACACTGGAGAAGGAACCAAGGACTTTCAAA
GCAAAGGAGCTATGGGAAAAAATGGAGCTGTGATTATGGCCGTGCGGAGGCCAGGCTGTTT
CCTCTGTCGAGAGGAAGCTGCGGATCTGTCCTCCCTGAAAAGCATGTTGGACCAGCTGGGCG
TCCCCCTCTATGCAGTGGTAAAGGAGCACATCAGGACTGAAGTGAAGGATTTCCAGCCTTAT
TTCAAGGAGAAATCTTCCTGGATGAAAGAAAAGTTCTATGGTCCACAAAGGCGGAAGAT
GATGTTTATGGATTTATCCGTCTGGGAGTGTGGTACAACTTCTTCCGAGCCTGGAACGGAG
GCTTCTCTGGAAACCTGGAAGGAGAAGGCTTCATCCTTGGGGGAGTTTTCGTGGTGGGATCA
GGAAAGCAGGGCATTCTTCTTGAGCACCGAGAAAAGAATTTGGAGACAAAGTAAACCTACT
TTCTGTTCTGGAAGCTGCTAAGATGATCAAACCACAGACTTTGGCCTCAGAGAAAAATGAT
TGTGTGAAACTGCCCAGCTCAGGGATAACCAGGGACATTCACCTGTGTTCATGGGATGTATT
GTTTCCACTCGTGTCCCTAAGGAGTGAGAAACCCATTTATACTCTACTCTCAGTATGGATTA
TTAATGTATTTTAATATTCTGTTTAGGCCCACTAAGGCAAAATAGCCCCAAAACAAGACTGA
CAAAAATCTGAAAAACTAATGAGGATTATTAAGCTAAAACCTGGGAAATAGGAGGCTTAAAA
TTGACTGCCAGGCTGGGTGCAGTGGCTCACACCTGTAATCCCAGCACTTTGGGAGGCCAAGG
TGAGCAAGTCACTTGAGGTCGGGAGTTCGAGACCAGCCTGAGCAACATGGCGAAACCCCGTC
TCTACTAAAAATACAAAAATCACCCGGGTGTGGTGGCAGGCACCTGTAGTCCCAGCTACCCG
GGAGGCTGAGGCAGGAGAATCACTTGAACCTGGGAGGTGGAGGTTGCGGTGAGCTGAGATCA
CACCACTGTATTCCAGCCTGGGTGACTGAGACTCTAACTAA
```

FIGURE 268

MSFLQDPSFFTMGMWSIGAGALGAAALALLLANTDVFLSKPQKAALEYLEDIDLKTLEKEPR
TFKAKELWEKNGAVIMAVRRPGCFLCREEAADLSSLKSMLDQLGVPLYAVVKEHIRTEVKDF
QPYFKGEIFLDEKKKFYGPQRRKMMFMGFIRLGVWYNFFRAWNGGFSGNLEGEGFILGGVFV
VGSGKQGILLEHREKEFGDKVNLLSVLEAAKMIKPQTLASEKK

FIGURE 269

ACGGACCGAGGGTTCGAGGGAGGGACACGGACCAGGAACCTGAGCTAGGTCAAAGACGCCCG
GGCCAGGTGCCCCGTCGCAGGTGCCCCTGGCCGGAGATGCGGTAGGAGGGGCGAGCGCGAGA
AGCCCCTTCCTCGGCGCTGCCAACCCGCCACCCAGCCCATGGCGAACCCCGGGCTGGGGCTG
CTTCTGGCGCTGGGCCTGCCGTTCCTGCTGGCCCGCTGGGGCCGAGCCTGGGGGCAAATACA
GACCACTTCTGCAAATGAGAATAGCACTGTTTTGCCTTCATCCACCAGCTCCAGCTCCGATG
GCAACCTGCGTCCGGAAGCCATCACTGCTATCATCGTGGTCTTCTCCCTCTTGGCTGCCTTG
CTCCTGGCTGTGGGGCTGGCACTGTTGGTGCGGAAGCTTCGGGAGAAGCGGCAGACGGAGGG
CACCTACCGGCCCAGTAGCGAGGAGCAGTTCTCCCATGCAGCCGAGGCCCGGGCCCCTCAGG
ACTCCAAGGAGACGGTGCAGGGCTGCCTGCCCATCTAGGTCCCCTCTCCTGCATCTGTCTCC
CTTCATTGCTGTGTGACCTTGGGGAAAGGCAGTGCCCTCTCTGGGCAGTCAGATCCACCCAG
TGCTTAATAGCAGGGAAGAAGGTACTTCAAAGACTCTGCCCCTGAGGTCAAGAGAGGATGGG
GCTATTCACTTTTATATATTTATATAAAATTAGTAGTGAGATGTAAAAAAAAAAAAAAAAA

FIGURE 270

MANPGLGLLLALGLPFLLARWGRAWGQIQTTSANENSTVLPSSTSSSSDGNLRPEAITAIIV
VFSLLAALLLAVGLALLVRKLREKRQTEGTYRPSSEEQFSHAAEARAPQDSKETVQGCLPI

FIGURE 271

AATATATCATCTATTTATCATTAATCAATAATGTATTCTTTTATTCCAATAACATTTGGGTT
TTGGGATTTTAATTTTCAAACACAGCAGAATGACATTTTTTCTGTCACTATTATTATTGTTG
GTATGTGAAGCTATTTGGAGATCCAATTCAGGAAGCAACACATTGGAGAATGGCTACTTTCT
ATCAAGAAATAAAGAGAACCACAGTCAACCCACACAATCATCTTTAGAAGACAGTGTGACTC
CTACCAAAGCTGTCAAACCACAGGCAAGGGCATAGTTAAAGGACGGAATCTTGACTCAAGA
GGGTTAATTCTTGGTGCTGAAGCCTGGGGCAGGGGTGTAAAGAAAAACACTTAGATTCAATG
ATTGTAAATTTAAGGCAAATACACATATTAGTATTACCTTAGTGTAATGTATCCCTGTCATA
TATACAATAAGGTGAAATTATAAGTACCCTATGCAGTTGGCTGGACAGTTCTAAATTGGACT
TTATTAATTTTTAAAATCAGTAACTGATTTATCACTGGCTATGTGCTTAGATCTACAGGAGA
TCATATAATTTGATACAAATAAAAGAAAAGTGTTCTCTCCCCTTACAGAATTGACATTTTAA
ATGCGATACAGTTAGAATAGGAAATATGACATTAGAAAGGAAGAATGACAGGGAGAAAGGAA
AGAAGGGAAATGTTGCCAAGGAAAAAAAA

FIGURE 272

MTFFLSLLLLLVCEAIWRSNSGSNTLENGYFLSRNKENHSQPTQSSLEDSVTPTKAVKTTGK
GIVKGRNLDSRGLILGAEAWGRGVKKNT

FIGURE 273

```
GCCAGGAATAACTAGAGAGGAACAATGGGGTTATTCAGAGGTTTTGTTTTCCTCTTAGTTCT
GTGCCTGCTGCACCAGTCAAATACTTCCTTCATTAAGCTGAATAATAATGGCTTTGAAGATA
TTGTCATTGTTATAGATCCTAGTGTGCCAGAAGATGAAAAAATAATTGAACAAATAGAGGAT
ATGGTGACTACAGCTTCTACGTACCTGTTTGAAGCCACAGAAAAAGATTTTTTTTCAAAAA
TGTATCTATATTAATTCCTGAGAATTGGAAGGAAATCCTCAGTACAAAAGGCCAAAACATG
AAAACCATAAACATGCTGATGTTATAGTTGCACCACCTACACTCCCAGGTAGAGATGAACCA
TACACCAAGCAGTTCACAGAATGTGGAGAGAAAGGCGAATACATTCACTTCACCCCTGACCT
TCTACTTGGAAAAAAACAAAATGAATATGGACCACCAGGCAAACTGTTTGTCCATGAGTGGG
CTCACCTCCGGTGGGGAGTGTTTGATGAGTACAATGAAGATCAGCCTTTCTACCGTGCTAAG
TCAAAAAAATCGAAGCAACAAGGTGTTCCGCAGGTATCTCTGGTAGAAATAGAGTTTATAA
GTGTCAAGGAGGCAGCTGTCTTAGTAGAGCATGCAGAATTGATTCTACAACAAAACTGTATG
GAAAAGATTGTCAATTCTTTCCTGATAAAGTACAAACAGAAAAGCATCCATAATGTTTATG
CAAAGTATTGATTCTGTTGTTGAATTTTGTAACGAAAAAACCCATAATCAAGAAGCTCCAAG
CCTACAAAACATAAAGTGCAATTTTAGAAGTACATGGGAGGTGATTAGCAATTCTGAGGATT
TTAAAAACACCATACCCATGGTGACACCACCTCCTCCACCTGTCTTCTCATTGCTGAAGATC
AGTCAAAGAATTGTGTGCTTAGTTCTTGATAAGTCTGGAAGCATGGGGGGTAAGGACCGCCT
AAATCGAATGAATCAAGCAGCAAAACATTTCCTGCTGCAGACTGTTGAAAATGGATCCTGGG
TGGGGATGGTTCACTTTGATAGTACTGCCACTATTGTAAATAAGCTAATCCAAATAAAAAGC
AGTGATGAAAGAAACACACTCATGGCAGGATTACCTACATATCCTCTGGGAGGAACTTCCAT
CTGCTCTGGAATTAAATATGCATTTCAGGTGATTGGAGAGCTACATTCCCAACTCGATGGAT
CCGAAGTACTGCTGCTGACTGATGGGGAGGATAACACTGCAAGTTCTTGTATTGATGAAGTG
AAACAAAGTGGGGCCATTGTTCATTTTATTGCTTTGGGAAGAGCTGCTGATGAAGCAGTAAT
AGAGATGAGCAAGATAACAGGAGGAAGTCATTTTTATGTTTCAGATGAAGCTCAGAACAATG
GCCTCATTGATGCTTTTGGGGCTCTTACATCAGGAAATACTGATCTCTCCCAGAAGTCCCTT
CAGCTCGAAAGTAAGGGATTAACACTGAATAGTAATGCCTGGATGAACGACACTGTCATAAT
TGATAGTACAGTGGGAAAGGACACGTTCTTTCTCATCACATGGAACAGTCTGCCTCCCAGTA
TTTCTCTCTGGGATCCCAGTGGAACAATAATGGAAAATTTCACAGTGGATGCAACTTCCAAA
ATGGCCTATCTCAGTATTCCAGGAACTGCAAAGGTGGGCACTTGGGCATACAATCTTCAAGC
CAAAGCGAACCCAGAAACATTAACTATTACAGTAACTTCTCGAGCAGCAAATTCTTCTGTGC
CTCCAATCACAGTGAATGCTAAAATGAATAAGGACGTAAACAGTTTCCCCAGCCCAATGATT
GTTTACGCAGAAATTCTACAAGGATATGTACCTGTTCTTGGAGCCAATGTGACTGCTTTCAT
TGAATCACAGAATGGACATACAGAAGTTTTGGAACTTTTGGATAATGGTGCAGGCGCTGATT
CTTTCAAGAATGATGGAGTCTACTCCAGGTATTTTACAGCATATACAGAAAATGGCAGATAT
AGCTTAAAAGTTCGGGCTCATGGAGGAGCAAACACTGCCAGGCTAAAATTACGGCCTCCACT
GAATAGAGCCGCGTACATACCAGGCTGGGTAGTGAACGGGGAAATTGAAGCAAACCGCCAA
GACCTGAAATTGATGAGGATACTCAGACCACCTTGGAGGATTTCAGCCGAACAGCATCCGGA
GGTGCATTTGTGGTATCACAAGTCCCAAGCCTTCCCTTGCCTGACCAATACCCACCAAGTCA
AATCACAGACCTTGATGCCACAGTTCATGAGGATAAGATTATTCTTACATGGACAGCACCAG
GAGATAATTTTGATGTTGGAAAAGTTCAACGTTATATCATAAGAATAAGTGCAAGTATTCTT
GATCTAAGAGACAGTTTTGATGATGCTCTTCAAGTAAATACTACTGATCTGTCACCAAAGGA
GGCCAACTCCAAGGAAAGCTTTGCATTTAAACCAGAAAATATCTCAGAAGAAATGCAACCC
ACATATTTATTGCCATTAAAAGTATAGATAAAAGCAATTTGACATCAAAAGTATCCAACATT
GCACAAGTAACTTTGTTTATCCCTCAAGCAAATCCTGATGACATTGATCCTACACCTACTCC
TACTCCTACTCCTACTCCTGATAAAAGTCATAATTCTGGAGTTAATATTTCTACGCTGGTAT
TGTCTGTGATTGGGTCTGTTGTAATTGTTAACTTTATTTTAAGTACCACCATTTGAACCTTA
ACGAAGAAAAAATCTTCAAGTAGACCTAGAAGAGAGTTTTAAAAAACAAAACAATGTAAGT
AAAGGATATTTCTGAATCTTAAAATTCATCCCATGTGTGATCATAAACTCATAAAATAATT
TTAAGATGTCGGAAAAGGATACTTTGATTAAATAAAAACACTCATGGATATGTAAAAACTGT
CAAGATTAAAATTTAATAGTTTCATTTATTTGTTATTTTATTTGTAAGAAATAGTGATGAAC
AAAGATCCTTTTTCATACTGATACCTGGTTGTATATTTATTTGATGCAACAGTTTTCTGAAAT
GATATTTCAAATTGCATCAAGAAATTAAAATCATCTATCTGAGTAGTCAAAATACAAGTAAA
GGAGAGCAAATAAACAACATTTGGAAAAAAAAAAAAAAAAAAAAAAAAAAAAAAAAAAAAA
AAAAAAAAAAAAAAAAAAAAAAAAAAAAAAAAAAAAAAAA
```

FIGURE 274

MGLFRGFVFLLVLCLLHQSNTSFIKLNNNGFEDIVIVIDPSVPEDEKIIEQIEDMVTTASTY
LFEATEKRFFFKNVSILIPENWKENPQYKRPKHENHKHADVIVAPPTLPGRDEPYTKQFTEC
GEKGEYIHFTPDLLLGKKQNEYGPPGKLFVHEWAHLRWGVFDEYNEDQPFYRAKSKKIEATR
CSAGISGRNRVYKCQGGSCLSRACRIDSTTKLYGKDCQFFPDKVQTEKASIMFMQSIDSVVE
FCNEKTHNQEAPSLQNIKCNFRSTWEVISNSEDFKNTIPMVTPPPPPVFSLLKISQRIVCLV
LDKSGSMGGKDRLNRMNQAAKHFLLQTVENGSWVGMVHFDSTATIVNKLIQIKSSDERNTLM
AGLPTYPLGGTSICSGIKYAFQVIGELHSQLDGSEVLLLTDGEDNTASSCIDEVKQSGAIVH
FIALGRAADEAVIEMSKITGGSHFYVSDEAQNNGLIDAFGALTSGNTDLSQKSLQLESKGLT
LNSNAWMNDTVIIDSTVGKDTFFLITWNSLPPSISLWDPSGTIMENFTVDATSKMAYLSIPG
TAKVGTWAYNLQAKANPETLTITVTSRAANSSVPPITVNAKMNKDVNSFPSPMIVYAEILQG
YVPVLGANVTAFIESQNGHTEVLELLDNGAGADSFKNDGVYSRYFTAYTENGRYSLKVRAHG
GANTARLKLRPPLNRAAYIPGWVVNGEIEANPPRPEIDEDTQTTLEDFSRTASGGAFVVSQV
PSLPLPDQYPPSQITDLDATVHEDKIILTWTAPGDNFDVGKVQRYIIRISASILDLRDSFDD
ALQVNTTDLSPKEANSKESFAFKPENISEENATHIFIAIKSIDKSNLTSKVSNIAQVTLFIP
QANPDDIDPTPTPTPTPDKSHNSGVNISTLVLSVIGSVVIVNFILSTTI

Signal peptide:

amino acids 1-21

Putative transmembrane domains:

amino acids 284-300, 617-633

Leucine zipper pattern.

amino acids 469-491, 476-498

N-glycosylation site.

amino acids 20-24, 75-79, 340-344, 504-508, 542-546, 588-592,
628-632, 811-815, 832-836, 837-841, 852-856, 896-900

FIGURE 275

```
CTCCTTAGGTGGAAACCCTGGGAGTAGAGTACTGACAGCAAAGACCGGGAAAGACCATACGTCCCCG
GGCAGGGGTGACAACAGGTGTCATCTTTTTGATCTCGTGTGTGGCTGCCTTCCTATTTCAAGGAAAG
ACGCCAAGGTAATTTTGACCCAGAGGAGCAATGATGTAGCCACCTCCTAACCTTCCCTTCTTGAACC
CCCAGTTATGCCAGGATTTACTAGAGAGTGTCAACTCAACCAGCAAGCGGCTCCTTCGGCTTAACTT
GTGGTTGGAGGAGAGAACCTTTGTGGGGCTGCGTTCTCTTAGCAGTGCTCAGAAGTGACTTGCCTGA
GGGTGGACCAGAAGAAAGGAAAGGTCCCCTCTTGCTGTTGGCTGCACATCAGGAAGGCTGTGATGGG
AATGAAGGTGAAAACTTGGAGATTTCACTTCAGTCATTGCTTCTGCCTGCAAGATCATCCTTTAAAA
GTAGAGAAGCTGCTCTGTGTGGTGGTTAACTCCAAGAGGCAGAACTCGTTCTAGAAGGAAATGGATG
CAAGCAGCTCCGGGGGCCCCAAACGCATGCTTCCTGTGGTCTAGCCCAGGGAAGCCCTTCCGTGGGG
GCCCCGGCTTTGAGGGATGCCACCGGTTCTGGACGCATGGCTGATTCCTGAATGATGATGGTTCGCC
GGGGGCTGCTTGCGTGGATTTCCCGGGTGGTGGTTTTGCTGGTGCTCCTCTGCTGTGCTATCTCTGT
CCTGTACATGTTGGCCTGCACCCCAAAAGGTGACGAGGAGCAGCTGGCACTGCCCAGGGCCAACAGC
CCCACGGGGAAGGAGGGGTACCAGGCCGTCCTTCAGGAGTGGGAGGAGCAGCACCGCAACTACGTGA
GCAGCCTGAAGCGGCAGATCGCACAGCTCAAGGAGGAGCTGCAGGAGAGGAGTGAGCAGCTCAGGAA
TGGGCAGTACCAAGCCAGCGATGCTGCTGGCCTGGGTCTGGACAGGAGCCCCCCAGAGAAAACCCAG
GCCGACCTCCTGGCCTTCCTGCACTCGCAGGTGGACAAGGCAGAGGTGAATGCTGGCGTCAAGCTGG
CCACAGAGTATGCAGCAGTGCCTTTCGATAGCTTTACTCTACAGAAGGTGTACCAGCTGGAGACTGG
CCTTACCCGCCACCCCGAGGAGAAGCCTGTGAGGAAGGACAAGCGGGATGAGTTGGTGGAAGCCATT
GAATCAGCCTTGGAGACCCTGAACAATCCTGCAGAGAACAGCCCCAATCACCGTCCTTACACGGCCT
CTGATTTCATAGAAGGGATCTACCGAACAGAAAGGGACAAAGGGACATTGTATGAGCTCACCTTCAA
AGGGGACCACAAACACGAATTCAAACGGCTCATCTTATTTCGACCATTCAGCCCCATCATGAAAGTG
AAAAATGAAAAGCTCAACATGGCCAACACGCTTATCAATGTTATCGTGCCTCTAGCAAAAAGGGTGG
ACAAGTTCCGGCAGTTCATGCAGAATTTCAGGGAGATGTGCATTGAGCAGGATGGGAGAGTCCATCT
CACTGTTGTTTACTTTGGGAAAGAAGAAATAAATGAAGTCAAAGGAATACTTGAAAACACTTCCAAA
GCTGCCAACTTCAGGAACTTTACCTTCATCCAGCTGAATGGAGAATTTTCTCGGGGAAAGGGACTTG
ATGTTGGAGCCCGCTTCTGGAAGGGAAGCAACGTCCTTCTCTTTTTCTGTGATGTGGACATCTACTT
CACATCTGAATTCCTCAATACGTGTAGGCTGAATACACAGCCAGGGAAGAAGGTATTTTATCCAGTT
CTTTTCAGTCAGTACAATCCTGGCATAATATACGGCCACCATGATGCAGTCCCTCCCTTGGAACAGC
AGCTGGTCATAAAGAAGGAAACTGGATTTTGGAGAGACTTTGGATTTGGGATGACGTGTCAGTATCG
GTCAGACTTCATCAATATAGGTGGGTTTGATCTGGACATCAAAGGCTGGGGCGGAGAGGATGTGCAC
CTTTATCGCAAGTATCTCCACAGCAACCTCATAGTGGTACGGACGCCTGTGCGAGGACTCTTCCACC
TCTGGCATGAGAAGCGCTGCATGGACGAGCTGACCCCCGAGCAGTACAAGATGTGCATGCAGTCCAA
GGCCATGAACGAGGCATCCCACGGCCAGCTGGGCATGCTGGTGTTCAGGCACGAGATAGAGGCTCAC
CTTCGCAAACAGAAACAGAAGACAAGTAGCAAAAAACATGAACTCCCAGAGAAGGATTGTGGGAGA
CACTTTTTCTTTCCTTTTGCAATTACTGAAAGTGGCTGCAACAGAGAAAGACTTCCATAAAGGACG
ACAAAAGAATTGGACTGATGGGTCAGAGATGAGAAAGCCTCCGATTTCTCTCTGTTGGGCTTTTTAC
AACAGAAATCAAAATCTCCGCTTTGCCTGCAAAAGTAACCCAGTTGCACCCTGTGAAGTGTCTGACA
AAGGCAGAATGCTTGTGAGATTATAAGCCTAATGGTGTGGAGGTTTTGATGGTGTTTACAATACACT
GAGACCTGTTGTTTTGTGTGCTCATTGAAATATTCATGATTTAAGAGCAGTTTTGTAAAAAATTCAT
TAGCATGAAAGGCAAGCATATTTCTCCTCATATGAATGAGCCTATCAGCAGGGCTCTAGTTTCTAGG
AATGCTAAAATATCAGAAGGCAGGAGAGGAGATAGGCTTATTATGATACTAGTGAGTACATTAAGTA
AAATAAAATGGACCAGAAAAGAAAAGAAACCATAAATATCGTGTCATATTTTCCCCAAGATTAACCA
AAAATAATCTGCTTATCTTTTGGTTGTCCTTTTAACTGTCTCCGTTTTTTCTTTTATTTAAAAAT
GCACTTTTTTTCCCTTGTGAGTTATAGTCTGCTTATTTAATTACCACTTTGCAAGCCTTACAAGAGA
GCACAAGTTGGCCTACATTTTTATATTTTTAAGAAGATACTTTGAGATGCATTATGAGAACTTTCA
GTTCAAAGCATCAAATTGATGCCATATCCAAGGACATGCCAAATGCTGATTCTGTCAGGCACTGAAT
GTCAGGCATTGAGACATAGGGAAGGAATGGTTTGTACTAATACAGACGTACAGATACTTTCTCTGAA
GAGTATTTTCGAAGAGGAGCAACTGAACACTGGAGGAAAGAAAATGACACTTTCTGCTTTACAGAA
AAGGAAACTCATTCAGACTGGTGATATCGTGATGTACCTAAAAGTCAGAACCACATTTTCTCCTCA
GAAGTAGGGACCGCTTTCTTACCTGTTTAAATAAACCAAAGTATACCGTGTGAACCAAACAATCTCT
TTTCAAAACAGGGTGCTCCTCCTGGCTTCTGGCTTCCATAAGAAGAAATGGAGAAAAATATATATAT
ATATATATATATTGTGAAAGATCAATCCATCTGCCAGAATCTAGTGGGATGGAAGTTTTTGCTACAT
GTTATCCACCCCAGGCCAGGTGGAAGTAACTGAATTATTTTTTAAATTAAGCAGTTCTACTCAATCA
CCAAGATGCTTCTGAAAATTGCATTTTATTACCATTTCAAACTATTTTTTAAAAATAAATACAGTTA
ACATAGAGTGGTTTCTTCATTCATGTGAAAATTATTAGCCAGCACCAGATGCATGAGCTAATTATCT
CTTTGAGTCCTTGCTTCTGTTTGCTCACAGTAAACTCATTGTTTAAAAGCTTCAAGAACATTCAAGC
TGTTGGTGTGTTAAAAAATGCATTGTATTGATTTGTACTGGTAGTTTATGAAATTTAATTAAAACAC
AGGCCATGAATGGAAGGTGGTATTGCACAGCTAATAAAATATGATTTGTGGATATGAA
```

FIGURE 276

MMMVRRGLLAWISRVVVLLVLLCCAISVLYMLACTPKGDEEQLALPRANSPTGKEGYQAVLQ
EWEEQHRNYVSSLKRQIAQLKEELQERSEQLRNGQYQASDAAGLGLDRSPPEKTQADLLAFL
HSQVDKAEVNAGVKLATEYAAVPFDSFTLQKVYQLETGLTRHPEEKPVRKDKRDELVEAIES
ALETLNNPAENSPNHRPYTASDFIEGIYRTERDKGTLYELTFKGDHKHEFKRLILFRPFSPI
MKVKNEKLNMANTLINVIVPLAKRVDKFRQFMQNFREMCIEQDGRVHLTVVYFGKEEINEVK
GILENTSKAANFRNFTFIQLNGEFSRGKGLDVGARFWKGSNVLLFFCDVDIYFTSEFLNTCR
LNTQPGKKVFYPVLFSQYNPGIIYGHHDAVPPLEQQLVIKKETGFWRDFGFGMTCQYRSDFI
NIGGFDLDIKGWGGEDVHLYRKYLHSNLIVVRTPVRGLFHLWHEKRCMDELTPEQYKMCMQS
KAMNEASHGQLGMLVFRHEIEAHLRKQKQKTSSKKT

FIGURE 277

```
GAAAGAATGTTGTGGCTGCTCTTTTTTCTGGTGACTGCCATTCATGCTGAACTCTGTCAACC
AGGTGCAGAAAATGCTTTTAAAGTGAGACTTAGTATCAGAACAGCTCTGGGAGATAAAGCAT
ATGCCTGGGATACCAATGAAGAATACCTCTTCAAAGCGATGGTAGCTTTCTCCATGAGAAAA
GTTCCCAACAGAGAAGCAACAGAAATTTCCCATGTCCTACTTTGCAATGTAACCCAGAGGGT
ATCATTCTGGTTTGTGGTTACAGACCCTTCAAAAAATCACACCCTTCCTGCTGTTGAGGTGC
AATCAGCCATAAGAATGAACAAGAACCGGATCAACAATGCCTTCTTTCTAAATGACCAAACT
CTGGAATTTTTAAAAATCCCTTCCACACTTGCACCACCCATGGACCCATCTGTGCCCATCTG
GATTATTATATTTGGTGTGATATTTTGCATCATCATAGTTGCAATTGCACTACTGATTTTAT
CAGGGATCTGGCAACGTAGAAGAAAGAACAAAGAACCATCTGAAGTGGATGACGCTGAAGAT
AAGTGTGAAAACATGATCACAATTGAAAATGGCATCCCCTCTGATCCCCTGGACATGAAGGG
GGGCATATTAATGATGCCTTCATGACAGAGGATGAGAGGCTCACCCCTCTCTGAAGGGCTGT
TGTTCTGCTTCCTCAAGAAATTAAACATTTGTTTCTGTGTGACTGCTGAGCATCCTGAAATA
CCAAGAGCAGATCATATATTTTGTTTCACCATTCTTCTTTTGTAATAAATTTTGAATGTGCT
TGAAAGTGAAAAGCAATCAATTATACCCACCAACACCACTGAAATCATAAGCTATTCACGAC
TCAAAATATTCTAAAATATTTTCTGACAGTATAGTGTATAAATGTGGTCATGTGGTATTTG
TAGTTATTGATTTAAGCATTTTTAGAAATAAGATCAGGCATATGTATATATTTTCACACTTC
AAAGACCTAAGGAAAAATAAATTTTCCAGTGGAGAATACATATAATATGGTGTAGAAATCAT
TGAAAATGGATCCTTTTTGACGATCACTTATATCACTCTGTATATGACTAAGTAAACAAAAG
TGAGAAGTAATTATTGTAAATGGATGGATAAAAATGGAATTACTCATATACAGGGTGGAATT
TTATCCTGTTATCACACCAACAGTTGATTATATATTTTCTGAATATCAGCCCCTAATAGGAC
AATTCTATTTGTTGACCATTTCTACAATTTGTAAAAGTCCAATCTGTGCTAACTTAATAAAG
TAATAATCATCTCTTTTAAAAAAAAAAAAAAAAAAAAAAAAA
```

FIGURE 278

MLWLLFFLVTAIHAELCQPGAENAFKVRLSIRTALGDKAYAWDTNEEYLFKAMVAFSMRKVP
NREATEISHVLLCNVTQRVSFWFVVTDPSKNHTLPAVEVQSAIRMNKNRINNAFFLNDQTLE
FLKIPSTLAPPMDPSVPIWIIIFGVIFCIIIVAIALLILSGIWQRRRKNKEPSEVDDAEDKC
ENMITIENGIPSDPLDMKGGILMMPS

FIGURE 279

```
AACTCAAACTCCTCTCTCTGGGAAAACGCGGTGCTTGCTCCTCCCGGAGTGGCCTTGGCAGG
GTGTTGGAGCCCTCGGTCTGCCCCGTCCGGTCTCTGGGGCCAAGGCTGGGTTTCCCTCATGT
ATGGCAAGAGCTCTACTCGTGCGGTGCTTCTTCTCCTTGGCATACAGCTCACAGCTCTTTGG
CCTATAGCAGCTGTGGAAATTTATACCTCCCGGGTGCTGGAGGCTGTTAATGGGACAGATGC
TCGGTTAAAATGCACTTTCTCCAGCTTTGCCCCTGTGGGTGATGCTCTAACAGTGACCTGGA
ATTTTCGTCCTCTAGACGGGGGACCTGAGCAGTTTGTATTCTACTACCACATAGATCCCTTC
CAACCCATGAGTGGGCGGTTTAAGGACCGGGTGTCTTGGGATGGGAATCCTGAGCGGTACGA
TGCCTCCATCCTTCTCTGGAAACTGCAGTTCGACGACAATGGGACATACACCTGCCAGGTGA
AGAACCCACCTGATGTTGATGGGGTGATAGGGGAGATCCGGCTCAGCGTCGTGCACACTGTA
CGCTTCTCTGAGATCCACTTCCTGGCTCTGGCCATTGGCTCTGCCTGTGCACTGATGATCAT
AATAGTAATTGTAGTGGTCCTCTTCCAGCATTACCGGAAAAAGCGATGGGCCGAAAGAGCTC
ATAAAGTGGTGGAGATAAAATCAAAAGAAGAGGAAAGGCTCAACCAAGAGAAAAAGGTCTCT
GTTTATTTAGAAGACACAGACTAACAATTTTAGATGGAAGCTGAGATGATTTCCAAGAACAA
GAACCCTAGTATTTCTTGAAGTTAATGGAAACTTTTCTTTGGCTTTTCCAGTTGTGACCCGT
TTTCCAACCAGTTCTGCAGCATATTAGATTCTAGACAAGCAACACCCCTCTGGAGCCAGCAC
AGTGCTCCTCCATATCACCAGTCATACACAGCCTCATTATTAAGGTCTTATTTAATTTCAGA
GTGTAAATTTTTTCAAGTGCTCATTAGGTTTTATAAACAAGAAGCTACATTTTTGCCCTTAA
GACACTACTTACAGTGTTATGACTTGTATACACATATATTGGTATCAAAGGGGATAAAAGCC
AATTTGTCTGTTACATTTCCTTTCACGTATTTCTTTTAGCAGCACTTCTGCTACTAAAGTTA
ATGTGTTTACTCTCTTTCCTTCCCACATTCTCAATTAAAAGGTGAGCTAAGCCTCCTCGGTG
TTTCTGATTAACAGTAAATCCTAAATTCAAACTGTTAAATGACATTTTTATTTTTATGTCTC
TCCTTAACTATGAGACACATCTTGTTTTACTGAATTTCTTTCAATATTCCAGGTGATAGATT
TTTGTCG
```

FIGURE 280

MYGKSSTRAVLLLLGIQLTALWPIAAVEIYTSRVLEAVNGTDARLKCTFSSFAPVGDALTVT
WNFRPLDGGPEQFVFYYHIDPFQPMSGRFKDRVSWDGNPERYDASILLWKLQFDDNGTYTCQ
VKNPPDVDGVIGEIRLSVVHTVRFSEIHFLALAIGSACALMIIVIVVVLFQHYRKKRWAER
AHKVVEIKSKEEERLNQEKKVSVYLEDTD

FIGURE 281

GCATTTTTGTCTGTGCTCCCTGATCTTCAGGTCACCACCATGAAGTTCTTAGCAGTCCTGGT
ACTCTTGGGAGTTTCCATCTTTCTGGTCTCTGCCCAGAATCCGACAACAGCTGCTCCAGCTG
ACACGTATCCAGCTACTGGTCCTGCTGATGATGAAGCCCCTGATGCTGAAACCACTGCTGCT
GCAACCACTGCGACCACTGCTGCTCCTACCACTGCAACCACCGCTGCTTCTACCACTGCTCG
TAAAGACATTCCAGTTTTACCCAAATGGGTTGGGGATCTCCCGAATGGTAGAGTGTGTCCCT
GAGATGGAATCAGCTTGAGTCTTCTGCAATTGGTCACAACTATTCATGCTTCCTGTGATTTC
ATCCAACTACTTACCTTGCCTACGATATCCCCTTTATCTCTAATCAGTTTATTTTCTTTCAA
ATAAAAAATAACTATGAGCAACATAAAAAAAAAAAA

FIGURE 282

MKFLAVLVLLGVSIFLVSAQNPTTAAPADTYPATGPADDEAPDAETTAAATTATTAAPTTAT
TAASTTARKDIPVLPKWVGDLPNGRVCP

FIGURE 283

GGACTCTGAAGGTCCCAAGCAGCTGCTGAGGCCCCCAAGGAAGTGGTTCCAACCTTGGACCC
CTAGGGGTCTGGATTTGCTGGTTAACAAGATAACCTGAGGGCAGGACCCCATAGGGGATGC
TACCTCCTGCCCTTCCACCTGCCCTGGTGTTCACGGTGGCCTGGTCCCTCCTTGCCGAGAGA
GTGTCCTGGGTCAGGGACGCAGAGGACGCTCACAGACTCCAGCCCTTTGTTACCGAGAGGAC
ACTTGGCAAGGTCCAGCGATGGTCCGGAGTCCACACACAGACTGGCGGCAGGGCAGGAGGGG
GACAGTTCTGTTGTGCTTGGTTGGACAGTAAGAGGGTCTTGGCCAGTCCAGGGTGGGGGGCG
GCAAACTCCATAAAGAACCAGAGGGTCTGGGCCCCGGCCACAGAGTCATCTGCCCAGCTCCT
CTGCTGCTGGCCAGTGGGAGTGGCACGAGGTGGGGCTTTGTGCCAGTAAAACCACAGGCTGG
ATTTGCCTGCGGGCCATGGTCCCTGTCTAGGGCAGCAATTCTCAACCTTCTTGCTCTCAGGA
CCCCAAAGAGCTTTCATTGTATCTATTGATTTTTACCACATTAGCAATTAAAACTGAGAAAT
GGGCCGGGCACGGTGGCTCACGCCTGTAATCCCAGCACTTTGGGAGGCCGAGGCGGGTGGAT
CACCTGAGATCAGGAGTTCAAGACCAGCCTGGCCAACATGGTGAAACCTTGTCTACTAAAAA
TACAAAAAATTAGCCAGGCACAGTGGTGTGCACTGGTAGTCCCAGTTACTCGGGAGGCTGAG
GCAGGAAAATCGCTTGAACCCAGGAGGCGGACGTTGCGGTGAGCCGAGATCGCGCCGCTGAT
TCCAGCCTGGGCGACAAGAGTGAGACTCCATCTCACACA

FIGURE 284

MLPPALPPALVFTVAWSLLAERVSWVRDAEDAHRLQPFVTERTLGKVQRWSGVHTQTGGRAG
GGQFCCAWLDSKRVLASPGWGAANSIKNQRVWAPATESSAQLLCCWPVGVARGGALCQ

FIGURE 285

GTCATGCCAGTGCCTGCTCTGTGCCTGCTCTGGGCCCTGGCAATGGTGACCCGGCCTGCCTCA
GCGGCCCCATGGGCGGCCCAGAACTGGCACAGCATGAGGAGCTGACCCTGCTCTTCCATGG
GACCCTGCAGCTGGGCCAGGCCCTCAACGGTGTGTACAGGACCACGGAGGGACGGCTGACAA
AGGCCAGGAACAGCCTGGGTCTCTATGGCCGCACAATAGAACTCCTGGGGCAGGAGGTCAGC
CGGGGCCGGGATGCAGCCCAGGAACTTCGGGCAAGCCTGTTGGAGACTCAGATGGAGGAGGA
TATTCTGCAGCTGCAGGCAGAGGCCACAGCTGAGGTGCTGGGGGAGGTGGCCCAGGCACAGA
AGGTGCTACGGGACAGCGTGCAGCGGCTAGAAGTCCAGCTGAGGAGCGCCTGGCTGGGCCCT
GCCTACCGAGAATTTGAGGTCTTAAAGGCTCACGCTGACAAGCAGAGCCACATCCTATGGGC
CCTCACAGGCCACGTGCAGCGGCAGAGGCGGGAGATGGTGGCACAGCAGCATCGGCTGCGAC
AGATCCAGGAGAGACTCCACACAGCGGCGCTCCCAGCCTGAATCTGCCTGGATGGAACTGAG
GACCAATCATGCTGCAAGGAACACTTCCACGCCCGTGAGGCCCTGTGCAGGGAGGAGCTG
CCTGTTCACTGGGATCAGCCAGGGCGCCGGGCCCCACTTCTGAGCACAGAGCAGAGACAGAC
GCAGGCGGGACAAAGGCAGAGGATGTAGCCCCATTGGGGAGGGGTGGAGGAAGGACATGTA
CCCTTTCATGCCTACACACCCCTCATTAAAGCAGAGTCGTGGCATTTCAAAAAAAAAAAAA
AAAAAAAAAAAAAAAAAAAAA

FIGURE 286

MPVPALCLLWALAMVTRPASAAPMGGPELAQHEELTLLFHGTLQLGQALNGVYRTTEGRLTK
ARNSLGLYGRTIELLGQEVSRGRDAAQELRASLLETQMEEDILQLQAEATAEVLGEVAQAQK
VLRDSVQRLEVQLRSAWLGPAYREFEVLKAHADKQSHILWALTGHVQRQRREMVAQQHRLRQ
IQERLHTAALPA

FIGURE 287

```
GGCAACATGGCTCAGCAGGCTTGCCCCAGAGCCATGGCAAAGAATGGACTTGTAATTTGCAT
CCTGGTGATCACCTTACTCCTGGACCAGACCACCAGCCACACATCCAGATTAAAAGCCAGGA
AGCACAGCAAACGTCGAGTGAGAGACAAGGATGGAGATCTGAAGACTCAAATTGAAAAGCTC
TGGACAGAAGTCAATGCCTTGAAGGAAATTCAAGCCCTGCAGACAGTCTGTCTCCGAGGCAC
TAAAGTTCACAAGAAATGCTACCTTGCTTCAGAAGGTTTGAAGCATTTCCATGAGGCCAATG
AAGACTGCATTTCCAAAGGAGGAATCCTGGTTATCCCCAGGAACTCCGACGAAATCAACGCC
CTCCAAGACTATGGTAAAAGGAGCCTGCCAGGTGTCAATGACTTTTGGCTGGGCATCAATGA
CATGGTCACGGAAGGCAAGTTTGTTGACGTCAACGGAATCGCTATCTCCTTCCTCAACTGGG
ACCGTGCACAGCCTAACGGTGGCAAGCGAGAAACTGTGTCCTGTTCTCCAATCAGCTCAG
GGCAAGTGGAGTGATGAGGCCTGTCGCAGCAGCAAGAGATACATATGCGAGTTCACCATCCC
TAAATAGGTCTTTCTCCAATGTGTCCTCCAAGCAAGATTCATCATAACTTATAGGTTCATGA
TCTCTAAGATCAAGTAAAAATCATAATTTTTACTTATTAAAAAATTGCAACACAAGATCAAT
GTCCATAGCAATATGATAGCATCAGCCAATTTGCTAACACATTTCTTTGGGATTTTGCCCT
TCCTGGGGTATAGGGGATCAGAAATATTGATCCATGTGCACGCAGATAAAATGGCTTCTGCT
AAACAGACTAAAATCTTTCTCTCTAGTCTTTCTCACTTGTACAAACCCAGTTTGTTTTCAAA
AAATCACAGTAGCAATGCAACTCATCACTCTAGAAAAGCAAGCTTAGGCTACCTGAAAGATT
TTCCCTTGGAAGTTTAGCGTATGTTTGACTAACAAAAATTCCCTACATCAGAGACTCTAGGT
GCTATATAATCCAAAAACTTTTCAGCCTGTTGCTCATTCTGTCCCATGCTGGCAATAATACC
TTGTCAGCCCATTACCCTTATTTTGAATTGCTCCATCTCCTGGTGGGACTTGTATCTTGTCT
GCCATATCAGAACACAAACCCCTGAAGAGGTTCTGATTTGATTTTTTTTTTTCTTCATGCC
TACCCTTTTTTGGAAGTTTCCAGCCGCAATTTGAAATGAAATGACAAGGTGTATATTTGAT
CAATTTTCATTCCCACCATTGCATTACAACCTCTAACTTAAATGGGTAACCCTAAGGCATAT
CAAAGAAGCAGATTGCATGATAAACGGAAATAGAAAAAAGAACCTACATTTATTTTGCTTT
AGCATCCTTACTCTCACCTTTTATGAGATTGAGAGTGGACTTACATTTCCTTTTTTACATTT
TCGTATATTTATTTTTTTTAGCCATCATTATATGTTTAAGTCTATTATGGGCAACCAATCTT
TGGAAGCTGAAAACTGAATTTAAAGAATGCTATCTTGGAAAATTGCATACGTCTGTGCAATT
TTTTATTCTGCCTAGTGCTATTCTGCTTGTTTAACTAGATTGTACAAAATAACTTCATTGCT
TAATATCAAATTACAAAGTTTAGACTTGGAGGGAATGGGCTTTTTAGAAGCAAACAATTTT
AAATATATTTTGTTCTTCAAATAAATAGTGTTTAAACATTGAATGTGTTTTGTGAACAATAT
CCCACTTTGCAAACTTTAACTACACATGCTTGGAATTAAGTTTTAGCTGTTTTCATTGCTCA
ATAATAAAGCCTGAATTCTGATCAATAAAAAAAAAAAAAAAAAAAAAAAAA
```

FIGURE 288

MAQQACPRAMAKNGLVICILVITLLLDQTTSHTSRLKARKHSKRRVRDKDGDLKTQIEKLWT
EVNALKEIQALQTVCLRGTKVHKKCYLASEGLKHFHEANEDCISKGGILVIPRNSDEINALQ
DYGKRSLPGVNDFWLGINDMVTEGKFVDVNGIAISFLNWDRAQPNGGKRENCVLFSQSAQGK
WSDEACRSSKRYICEFTIPK

FIGURE 289

```
GCGAGGACCGGGTATAAGAAGCCTCGTGGCCTTGCCCGGGCAGCCGCAGGTTCCCCGCGCGC
CCCGAGCCCCGCGCCATGAAGCTCGCCGCCCTCCTGGGGCTCTGCGTGGCCCTGTCCTGCA
GCTCCGCTGCTGCTTTCTTAGTGGGCTCGGCCAAGCCTGTGGCCCAGCCTGTCGCTGCGCTG
GAGTCGGCGGCGGAGGCCGGGGCCGGGACCCTGGCCAACCCCCTCGGCACCCTCAACCCGCT
GAAGCTCCTGCTGAGCAGCCTGGGCATCCCCGTGAACCACCTCATAGAGGGCTCCCAGAAGT
GTGTGGCTGAGCTGGGTCCCCAGGCCGTGGGGGCCGTGAAGGCCCTGAAGGCCCTGCTGGGG
GCCCTGACAGTGTTTGGCTGAGCCGAGACTGGAGCATCTACACCTGAGGACAAGACGCTGCC
CACCCGCGAGGGCTGAAAACCCCGCCGCGGGGAGGACCGTCCATCCCCTTCCCCCGGCCCCT
CTCAATAAACGTGGTTAAGAGCAAAAAAAAAAAAAAAAAAAAAAAAAAAAAAAAAAAAAAAA
AAAAAAAAAAAA
```

FIGURE 290

MKLAALLGLCVALSCSSAAAFLVGSAKPVAQPVAALESAAEAGAGTLANPLGTLNPLKLLLS
SLGIPVNHLIEGSQKCVAELGPQAVGAVKALKALLGALTVFG

FIGURE 291

```
TGAAGGACTTTTCCAGGACCCAAGGCCACACACTGGAAGTCTTGCAGCTGAAGGGAGGCACT
CCTTGGCCTCCGCAGCCGATCACATGAAGGTGGTGCCAAGTCTCCTGCTCTCCGTCCTCCTG
GCACAGGTGTGGCTGGTACCCGGCTTGGCCCCAGTCCTCAGTCGCCAGAGACCCCAGCCCC
TCAGAACCAGACCAGCAGGGTAGTGCAGGCTCCCAGGGAGGAAGAGGAAGATGAGCAGGAGG
CCAGCGAGGAGAAGGCCGGTGAGGAAGAGAAAGCCTGGCTGATGGCCAGCAGGCAGCAGCTT
GCCAAGGAGACTTCAAACTTCGGATTCAGCCTGCTGCGAAAGATCTCCATGAGGCACGATGG
CAACATGGTCTTCTCTCCATTTGGCATGTCCTTGGCCATGACAGGCTTGATGCTGGGGGCCA
CAGGGCCGACTGAAACCCAGATCAAGAGAGGGCTCCACTTGCAGGCCCTGAAGCCCACCAAG
CCCGGGCTCCTGCCTTCCCTCTTTAAGGGACTCAGAGAGACCCTCTCCCGCAACCTGGAACT
GGGCCTCTCACAGGGGAGTTTTGCCTTCATCCACAAGGATTTTGATGTCAAAGAGACTTTCT
TCAATTTATCCAAGAGGTATTTTGATACAGAGTGCGTGCCTATGAATTTTCGCAATGCCTCA
CAGGCCAAAAGGCTCATGAATCATTACATTAACAAAGAGACTCGGGGGAAAATTCCCAAACT
GTTTGATGAGATTAATCCTGAAACCAAATTAATTCTTGTGGATTACATCTTGTTCAAAGGGA
AATGGTTGACCCCATTTGACCCTGTCTTCACCGAAGTCGACACTTTCCACCTGGACAAGTAC
AAGACCATTAAGGTGCCCATGATGTACGGTGCAGGCAAGTTTGCCTCCACCTTTGACAAGAA
TTTTCGTTGTCATGTCCTCAAACTGCCCTACCAAGGAAATGCCACCATGCTGGTGGTCCTCA
TGGAGAAAATGGGTGACCACCTCGCCCTTGAAGACTACCTGACCACAGACTTGGTGGAGACA
TGGCTCAGAAACATGAAAACCAGAAACATGGAAGTTTTCTTTCCGAAGTTCAAGCTAGATCA
GAAGTATGAGATGCATGAGCTGCTTAGGCAGATGGGAATCAGAAGAATCTTCTCACCCTTTG
CTGACCTTAGTGAACTCTCAGCTACTGGAAGAAATCTCCAAGTATCCAGGGTTTTACGAAGA
ACAGTGATTGAAGTTGATGAAAGGGGCACTGAGGCAGTGGCAGGAATCTTGTCAGAAATTAC
TGCTTATTCCATGCCTCCTGTCATCAAAGTGGACCGGCCATTTCATTTCATGATCTATGAAG
AAACCTCTGGAATGCTTCTGTTTCTGGGCAGGGTGGTGAATCCGACTCTCCTATAATTCAGG
ACATGCATAAGCACTTCGTGCTGTAGTAGATGCTGAATCTGAGGTATCAAACACACACAGGA
TACCAGCAATGGATGGCAGGGAGAGTGTTCCTTTTGTTCTTAACTAGTTTAGGGTGTTCTC
AAATAAATACAGTAGTCCCCACTTATCTGAGGGGATACATTCAAAGACCCCAGCAGATGC
CTGAAACGGTGGACAGTGCTGAACCTTATATATATTTTTCCTACACATACATACCTATGAT
AAAGTTTAATTTATAAATTAGGCACAGTAAGAGATTAACAATAATAACAACATTAAGTAAAA
TGAGTTACTTGAACGCAAGCACTGCAATACCATAACAGTCAAACTGATTATAGAGAAGGCTA
CTAAGTGACTCATGGGCGAGGAGCATAGACAGTGTGGAGACATTGGGCAAGGGGAGAATTCA
CATCCTGGGTGGGACAGAGCAGGACGATGCAAGATTCCATCCCACTACTCAGAATGGCATGC
TGCTTAAGACTTTTAGATTGTTTATTTCTGGAATTTTTCATTTAATGTTTTTGGACCATGGT
TGACCATGGTTAACTGAGACTGCAGAAAGCAAACCATGGATAAGGGAGGACTACTACAAAA
GCATTAAATTGATACATATTTTTTAAAAAAAAAAAAAAAAAAA
```

FIGURE 292

MKVVPSLLLSVLLAQVWLVPGLAPSPQSPETPAPQNQTSRVVQAPREEEEDEQEASEEKAGE
EEKAWLMASRQQLAKETSNFGFSLLRKISMRHDGNMVFSPFGMSLAMTGLMLGATGPTETQI
KRGLHLQALKPTKPGLLPSLFKGLRETLSRNLELGLSQGSFAFIHKDFDVKETFFNLSKRYF
DTECVPMNFRNASQAKRLMNHYINKETRGKIPKLFDEINPETKLILVDYILFKGKWLTPFDP
VFTEVDTFHLDKYKTIKVPMMYGAGKFASTFDKNFRCHVLKLPYQGNATMLVVLMEKMGDHL
ALEDYLTTDLVETWLRNMKTRNMEVFFPKFKLDQKYEMHELLRQMGIRRIFSPFADLSELSA
TGRNLQVSRVLRRTVIEVDERGTEAVAGILSEITAYSMPPVIKVDRPFHFMIYEETSGMLLF
LGRVVNPTLL

FIGURE 293

CTGGGATCAGCCACTGCAGCTCCCTGAGCACTCTCTACAGAGACGCGGACCCCAGACATGAG
GAGGCTCCTCCTGGTCACCAGCCTGGTGGTTGTGCTGCTGTGGGAGGCAGGTGCAGTCCCAG
CACCCAAGGTCCCTATCAAGATGCAAGTCAAACACTGGCCCTCAGAGCAGGACCCAGAGAAG
GCCTGGGGCGCCCGTGTGGTGGAGCCTCCGGAGAAGGACGACCAGCTGGTGGTGCTGTTCCC
TGTCCAGAAGCCGAAACTCTTGACCACCGAGGAGAAGCCACGAGGTCAGGGCAGGGGCCCCA
TCCTTCCAGGCACCAAGGCCTGGATGGAGACCGAGGACACCCTGGGCCGTGTCCTGAGTCCC
GAGCCCGACCATGACAGCCTGTACCACCTCCGCCTGAGGAGGACCAGGGCGAGGAGAGGCC
CCGGTTGTGGGTGATGCCAAATCACCAGGTGCTCCTGGGACCGGAGGAAGACCAAGACCACA
TCTACCACCCCAGTAGGGCTCCAGGGGCCATCACTGCCCCGCCCTGTCCCAAGGCCCAGG
CTGTTGGGACTGGGACCCTCCCTACCCTGCCCAGCTAGACAAATAAACCCCAGCAGGCAAA
AAAAAAAAAAAAAAAA

FIGURE 294

MRRLLLVTSLVVVLLWEAGAVPAPKVPIKMQVKHWPSEQDPEKAWGARVVEPPEKDDQLVVL
FPVQKPKLLTTEEKPRGQGRGPILPGTKAWMETEDTLGRVLSPEPDHDSLYHPPPEEDQGEE
RPRLWVMPNHQVLLGPEEDQDHIYHPQ

FIGURE 295

AGAAAGCTGCACTCTGTTGAGCTCCAGGGCGCAGTGGAGGGAGGGAGTGAAGGAGCTCTCTG
TACCCAAGGAAAGTGCAGCTGAGACTCAGACAAGATTACAATGAACCAACTCAGCTTCCTGC
TGTTTCTCATAGCGACCACCAGAGGATGGAGTACAGATGAGGCTAATACTTACTTCAAGGAA
TGGACCTGTTCTTCGTCTCCATCTCTGCCCAGAAGCTGCAAGGAAATCAAAGACGAATGTCC
TAGTGCATTTGATGGCCTGTATTTTCTCCGCACTGAGAATGGTGTTATCTACCAGACCTTCT
GTGACATGACCTCTGGGGGTGGCGGCTGGACCCTGGTGGCCAGCGTGCATGAGAATGACATG
CGTGGGAAGTGCACGGTGGGCGATCGCTGGTCCAGTCAGCAGGGCAGCAAAGCAGACTACCC
AGAGGGGGACGGCAACTGGGCCAACTACAACACCTTTGGATCTGCAGAGGCGGCCACGAGCG
ATGACTACAAGAACCCTGGCTACTACGACATCCAGGCCAAGGACCTGGGCATCTGGCACGTG
CCCAATAAGTCCCCCATGCAGCACTGGAGAAACAGCTCCCTGCTGAGGTACCGCACGGACAC
TGGCTTCCTCCAGACACTGGGACATAATCTGTTTGGCATCTACCAGAAATATCCAGTGAAAT
ATGGAGAAGGAAAGTGTTGGACTGACAACGGCCCGGTGATCCCTGTGGTCTATGATTTTGGC
GACGCCCAGAAAACAGCATCTTATTACTCACCCTATGGCCAGCGGGAATTCACTGCGGGATT
TGTTCAGTTCAGGGTATTTAATAACGAGAGAGCAGCCAACGCCTTGTGTGCTGGAATGAGGG
TCACCGGATGTAACACTGAGCATCACTGCATTGGTGGAGGAGGATACTTTCCAGAGGCCAGT
CCCCAGCAGTGTGGAGATTTTCTGGTTTTGATTGGAGTGGATATGGAACTCATGTTGGTTA
CAGCAGCAGCCGTGAGATAACTGAGGCAGCTGTGCTTCTATTCTATCGTTGAGAGTTTTGTG
GGAGGGAACCCAGACCTCTCCTCCCAACCATGAGATCCCAAGGATGGAGAACAACTTACCCA
GTAGCTAGAATGTTAATGGCAGAAGAGAAAACAATAAATCATATTGACTCAAGAAAAAAA

FIGURE 296

MNQLSFLLFLIATTRGWSTDEANTYFKEWTCSSSPSLPRSCKEIKDECPSAFDGLYFLRTEN
GVIYQTFCDMTSGGGGWTLVASVHENDMRGKCTVGDRWSSQQGSKADYPEGDGNWANYNTFG
SAEAATSDDYKNPGYYDIQAKDLGIWHVPNKSPMQHWRNSSLLRYRTDTGFLQTLGHNLFGI
YQKYPVKYGEGKCWTDNGPVIPVVYDFGDAQKTASYYSPYGQREFTAGFVQFRVFNNERAAN
ALCAGMRVTGCNTEHHCIGGGGYFPEASPQQCGDFSGFDWSGYGTHVGYSSSREITEAAVLL
FYR

FIGURE 297

GCGGAGCCGGCGCCGGCTGCGCAGAGGAGCCGCTCTCGCCGCCGCCACCTCGGCTGGGAGCC
CACGAGGCTGCCGCATCCTGCCCTCGGAACAATGGGACTCGGCGCGCGAGGTGCTTGGGCCG
CGCTGCTCCTGGGGACGCTGCAGGTGCTAGCGCTGCTGGGGGCCGCCCATGAAAGCGCAGCC
ATGGCGGCATCTGCAAACATAGAGAATTCTGGGCTTCCACACAACTCCAGTGCTAACTCAAC
AGAGACTCTCCAACATGTGCCTTCTGACCATACAAATGAAACTTCCAACAGTACTGTGAAAC
CACCAACTTCAGTTGCCTCAGACTCCAGTAATACAACGGTCACCACCATGAAACCTACAGCG
GCATCTAATACAACAACACCAGGGATGGTCTCAACAAATATGACTTCTACCACCTTAAAGTC
TACACCCAAAACAACAAGTGTTTCACAGAACACATCTCAGATATCAACATCCACAATGACCG
TAACCCACAATAGTTCAGTGACATCTGCTGCTTCATCAGTAACAATCACAACAACTATGCAT
TCTGAAGCAAAGAAGGATCAAAATTTGATACTGGGAGCTTTGTTGGTGGTATTGTATTAAC
GCTGGGAGTTTTATCTATTCTTTACATTGGATGCAAAATGTATTACTCAAGAAGAGGCATTC
GGTATCGAACCATAGATGAACATGATGCCATCATTTAAGGAAATCCATGGACCAAGGATGGA
ATACAGATTGATGCTGCCCTATCAATTAATTTTGGTTTATTAATAGTTTAAAACAATATTCT
CTTTTTGAAAATAGTATAAACAGGCCATGCATATAATGTACAGTGTATTACGTAAATATGTA
AAGATTCTTCAAGGTAACAAGGGTTTGGGTTTTGAAATAAACATCTGGATCTTATAGACCGT
TCATACAATGGTTTTAGCAAGTTCATAGTAAGACAAACAAGTCCTATCTTTTTTTTTGGCT
GGGGTGGGGGCATTGGTCACATATGACCAGTAATTGAAAGACGTCATCACTGAAAGACAGAA
TGCCATCTGGGCATACAAATAAGAAGTTTGTCACAGCACTCAGGATTTTGGGTATCTTTTGT
AGCTCACATAAAGAACTTCAGTGCTTTTCAGAGCTGGATATATCTTAATTACTAATGCCACA
CAGAAATTATACAATCAAACTAGATCTGAAGCATAATTTAAGAAAAACATCAACATTTTTG
TGCTTTAAACTGTAGTAGTTGGTCTAGAAACAAAATACTCC

FIGURE 298

MGLGARGAWAALLLGTLQVLALLGAAHESAAMAASANIENSGLPHNSSANSTETLQHVPSDH
TNETSNSTVKPPTSVASDSSNTTVTTMKPTAASNTTTPGMVSTNMTSTTLKSTPKTTSVSQN
TSQISTSTMTVTHNSSVTSAASSVTITTTMHSEAKKGSKFDTGSFVGGIVLTLGVLSILYIG
CKMYYSRRGIRYRTIDEHDAII

FIGURE 299

CAGCCGGGTCCCAAGCCTGTGCCTGAGCCTGAGCCTGAGCCTGAGCCCGAGCCGGGAGCCGG
TCGCGGGGGCTCCGGGCTGTGGGACCGCTGGGCCCCCAGCGATGGCGACCCTGTGGGGAGGC
CTTCTTCGGCTTGGCTCCTTGCTCAGCCTGTCGTGCCTGGCGCTTTCCGTGCTGCTGCTGGC
GCAGCTGTCAGACGCCGCCAAGAATTTCGAGGATGTCAGATGTAAATGTATCTGCCCTCCCT
ATAAAGAAATTCTGGGCATATTTATAATAAGAACATATCTCAGAAAGATTGTGATTGCCTT
CATGTTGTGGAGCCCATGCCTGTGCGGGGGCCTGATGTAGAAGCATACTGTCTACGCTGTGA
ATGCAAATATGAAGAAGAAGCTCTGTCACAATCAAGGTTACCATTATAATTTATCTCTCCA
TTTTGGGCCTTCTACTTCTGTACATGGTATATCTTACTCTGGTTGAGCCCATACTGAAGAGG
CGCCTCTTTGGACATGCACAGTTGATACAGAGTGATGATGATATTGGGGATCACCAGCCTTT
TGCAAATGCACACGATGTGCTAGCCCGCTCCCGCAGTCGAGCCAACGTGCTGAACAAGGTAG
AATATGCACAGCAGCGCTGGAAGCTTCAAGTCCAAGAGCAGCGAAAGTCTGTCTTTGACCGG
CATGTTGTCCTCAGCTAATTGGGAATTGAATTCAAGGTGACTAGAAAGAAACAGGCAGACAA
CTGGAAAGAACTGACTGGGTTTTGCTGGGTTTCATTTTAATACCTTGTTGATTTCACCAACT
GTTGCTGGAAGATTCAAAACTGGAAGCAAAACTTGCTTGATTTTTTTTCTTGTTAACGTA
ATAATAGAGACATTTTAAAAGCACACAGCTCAAAGTCAGCCAATAAGTCTTTTCCTATTTG
TGACTTTTACTAATAAAAATAAATCTGCCTGTAAATTATCTTGAAGTCCTTTACCTGGAACA
AGCACTCTCTTTTTCACCACATAGTTTTAACTTGACTTTCAAGATAATTTTCAGGGTTTTTG
TTGTTGTTGTTTTTTGTTTGTTTGTTTTGGTGGGAGAGGGGAGGGATGCCTGGGAAGTGGTT
AACAACTTTTTTCAAGTCACTTTACTAAACAAACTTTTGTAAATAGACCTTACCTTCTATTT
TCGAGTTTCATTTATATTTTGCAGTGTAGCCAGCCTCATCAAAGAGCTGACTTACTCATTTG
ACTTTTGCACTGACTGTATTATCTGGGTATCTGCTGTGTCTGCACTTCATGGTAAACGGGAT
CTAAAATGCCTGGTGGCTTTTCACAAAAAGCAGATTTTCTTCATGTACTGTGATGTCTGATG
CAATGCATCCTAGAACAAACTGGCCATTTGCTAGTTTACTCTAAAGACTAAACATAGTCTTG
GTGTGTGTGGTCTTACTCATCTTCTAGTACCTTTAAGGACAAATCCTAAGGACTTGGACACT
TGCAATAAAGAAATTTTATTTTAAACCCAAGCCTCCCTGGATTGATAATATATACACATTTG
TCAGCATTTCCGGTCGTGGTGAGAGGCAGCTGTTTGAGCTCCAATATGTGCAGCTTTGAACT
AGGGCTGGGGTTGTGGGTGCCTCTTCTGAAAGGTCTAACCATTATTGGATAACTGGCTTTTT
TCTTCCTATGTCCTCTTTGGAATGTAACAATAAAATAATTTTTGAAACATCAA

FIGURE 300

MATLWGGLLRLGSLLSLSCLALSVLLLAQLSDAAKNFEDVRCKCICPPYKENSGHIYNKNIS
QKDCDCLHVVEPMPVRGPDVEAYCLRCECKYEERSSVTIKVTIIIYLSILGLLLLYMVYLTL
VEPILKRRLFGHAQLIQSDDDIGDHQPFANAHDVLARSRSRANVLNKVEYAQQRWKLQVQEQ
RKSVFDRHVVLS

FIGURE 301

```
GCACCTGCGACCACCGTGAGCAGTCATGGCGTACTCCACAGTGCAGAGAGTCGCTCTGGCTT
CTGGGCTTGTCCTGGCTCTGTCGCTGCTGCTGCCCAAGGCCTTCCTGTCCCGCGGGAAGCGG
CAGGAGCCGCCGCCGACACCTGAAGGAAAATTGGGCCGATTTCCACCTATGATGCATCATCA
CCAGGCACCCTCAGATGGCCAGACTCCTGGGGCTCGTTTCCAGAGGTCTCACCTTGCCGAGG
CATTTGCAAAGGCCAAAGGATCAGGTGGAGGTGCTGGAGGAGGAGGTAGTGGAAGAGGTCTG
ATGGGGCAGATTATTCCAATCTACGGTTTTGGGATTTTTTTATATATACTGTACATTCTATT
TAAGGTAAGTAGAATCATCCTAATCATATTACATCAATGAAAATCTAATATGGCGATAAAAA
TCATTGTCTACATTAAAACTTCTTATAGTTCATAAAATTATTTCAAATCCATCATCTCTTTA
AATCCTGCCTCCTCTTCATGAGGTACTTAGGATAGCCATTATTTCAGTTTCACATAAGAATG
TTTACTCAATGTTTAAGTGTTTTGCCCCAAAATTCACAACTAACAAGGCAGAACTAGGACTT
GAACATGGATCTTTTGGTTCTTAATCCAGTGAGTGATACAATTCAATGCACTCCCTGCCA
```

FIGURE 302

MAYSTVQRVALASGLVLALSLLLPKAFLSRGKRQEPPPTPEGKLGRFPPMMHHHQAPSDGQT
PGARFQRSHLAEAFAKAKGSGGGAGGGGSGRGLMGQIIPIYGFGIFLYILYILFKVSRIILI
ILHQ

FIGURE 303

CGGCTCGAGTGCAGCTGTGGGGAGATTTCAGTGCATTGCCTCCCCTGGGTGCTCTTCATCTT
GGATTTGAAAGTTGAGAGCAGCATGTTTTGCCCACTGAAACTCATCCTGCTGCCAGTGTTAC
TGGATTATTCCTTGGGCCTGAATGACTTGAATGTTTCCCCGCCTGAGCTAACAGTCCATGTG
GGTGATTCAGCTCTGATGGGATGTGTTTTCCAGAGCACAGAAGACAAATGTATATTCAAGAT
AGACTGGACTCTGTCACCAGGAGAGCACGCCAAGGACGAATATGTGCTATACTATTACTCCA
ATCTCAGTGTGCCTATTGGGCGCTTCCAGAACCGCGTACACTTGATGGGGGACATCTTATGC
AATGATGGCTCTCTCCTGCTCCAAGATGTGCAAGAGGCTGACCAGGGAACCTATATCTGTGA
AATCCGCCTCAAAGGGGAGAGCCAGGTGTTCAAGAAGGCGGTGGTACTGCATGTGCTTCCAG
AGGAGCCCAAAGAGCTCATGGTCCATGTGGGTGGATTGATTCAGATGGGATGTGTTTTCCAG
AGCACAGAAGTGAAACACGTGACCAAGGTAGAATGGATATTTTCAGGACGGCGCGCAAAGGA
GGAGATTGTATTTCGTTACTACCACAAACTCAGGATGTCTGTGGAGTACTCCCAGAGCTGGG
GCCACTTCCAGAATCGTGTGAACCTGGTGGGGGACATTTTCCGCAATGACGGTTCCATCATG
CTTCAAGGAGTGAGGGAGTCAGATGGAGGAAACTACACCTGCAGTATCCACCTAGGGAACCT
GGTGTTCAAGAAAACCATTGTGCTGCATGTCAGCCCGGAAGAGCCTCGAACACTGGTGACCC
CGGCAGCCCTGAGGCCTCTGGTCTTGGGTGGTAATCAGTTGGTGATCATTGTGGGAATTGTC
TGTGCCACAATCCTGCTGCTCCCTGTTCTGATATTGATCGTGAAGAAGACCTGTGGAAATAA
GAGTTCAGTGAATTCTACAGTCTTGGTGAAGAACACGAAGAAGACTAATCCAGAGATAAAAG
AAAAACCCTGCCATTTTGAAAGATGTGAAGGGGAGAAACACATTTACTCCCCAATAATTGTA
CGGGAGGTGATCGAGGAAGAAGAACCAAGTGAAAAATCAGAGGCCACCTACATGACCATGCA
CCCAGTTTGGCCTTCTCTGAGGTCAGATCGGAACAACTCACTTGAAAAAAGTCAGGTGGGG
GAATGCCAAAAACACAGCAAGCCTTTTGAGAAGAATGGAGAGTCCCTTCATCTCAGCAGCGG
TGGAGACTCTCTCCTGTGTGTGTCCTGGGCCACTCTACCAGTGATTTCAGACTCCCGCTCTC
CCAGCTGTCCTCCTGTCTCATTGTTTGGTCAATACACTGAAGATGGAGAATTTGGAGCCTGG
CAGAGAGACTGGACAGCTCTGGAGGAACAGGCCTGCTGAGGGGAGGGGAGCATGGACTTGGC
CTCTGGAGTGGGACACTGGCCCTGGGAACCAGGCTGAGCTGAGTGGCCTCAAACCCCCGTT
GGATCAGACCCTCCTGTGGGCAGGGTTCTTAGTGGATGAGTTACTGGGAAGAATCAGAGATA
AAAACCAACCCAAATCAA

FIGURE 304

```
MFCPLKLILLPVLLDYSLGLNDLNVSPPELTVHVGDSALMGCVFQSTEDKCIFKIDWTLSPG
EHAKDEYVLYYYSNLSVPIGRFQNRVHLMGDILCNDGSLLLQDVQEADQGTYICEIRLKGES
QVFKKAVVLHVLPEEPKELMVHVGGLIQMGCVFQSTEVKHVTKVEWIFSGRRAKEEIVFRYY
HKLRMSVEYSQSWGHFQNRVNLVGDIFRNDGSIMLQGVRESDGGNYTCSIHLGNLVFKKTIV
LHVSPEEPRTLVTPAALRPLVLGGNQLVIIVGIVCATILLLPVLILIVKKTCGNKSSVNSTV
LVKNTKKTNPEIKEKPCHFERCEGEKHIYSPIIVREVIEEEEPSEKSEATYMTMHPVWPSLR
SDRNNSLEKKSGGGMPKTQQAF
```

FIGURE 305

CTATGAAGAAGCTTCCTGGAAAACAATAAGCAAAGGAAAACAAATGTGTCCCATCTCACATG
GTTCTACCCTACTAAAGACAGGAAGATCATAAACTGACAGATACTGAAATTGTAAGAGTTGG
AAACTACATTTTGCAAAGTCATTGAACTCTGAGCTCAGTTGCAGTACTCGGGAAGCATGCA
GGATGAAGATGGATACATCACCTTAAATATTAAAACTCGGAAACCAGCTCTCGTCTCCGTTG
GCCCTGCATCCTCCTCCTGGTGGCGTGTGATGGCTTTGATTCTGCTGATCCTGTGCGTGGGG
ATGGTTGTCGGGCTGGTGGCTCTGGGGATTTGGTCTGTCATGCAGCGCAATTACCTACAAGA
TGAGAATGAAAATCGCACAGGAACTCTGCAACAATTAGCAAAGCGCTTCTGTCAATATGTGG
TAAAACAATCAGAACTAAAGGGCACTTTCAAAGGTCATAAATGCAGCCCCTGTGACACAAAC
TGGAGATATTATGGAGATAGCTGCTATGGTTCTTCAGGCACAACTTAACATGGGAAGAGAG
TAAGCAGTACTGCACTGACATGAATGCTACTCCTGAAGATTGACAACCGGAACATTGTGG
AGTACATCAAAGCCAGGACTCATTTAATTCGTTGGGTCGGATTATCTCGCCAGAAGTCGAAT
GAGGTCTGGAAGTGGGAGGATGGCTCGGTTATCTCAGAAAATATGTTTGAGTTTTTGGAAGA
TGGAAAAGGAAATATGAATTGTGCTTATTTTCATAATGGGAAAATGCACCCTACCTTCTGTG
AGAACAAACATTATTTAATGTGTGAGAGGAAGGCTGGCATGACCAAGGTGGACCAACTACCT
TAATGCAAAGAGGTGGACAGGATAACACAGATAAGGGCTTTATTGTACAATAAAAGATATGT
ATGAATGCATCAGTAGCTGAAAAAAAAAAAAAA

FIGURE 306

MQDEDGYITLNIKTRKPALVSVGPASSSWWRVMALILLILCVGMVVGLVALGIWSVMQRNYL
QDENENRTGTLQQLAKRFCQYVVKQSELKGTFKGHKCSPCDTNWRYYGDSCYGFFRHNLTWE
ESKQYCTDMNATLLKIDNRNIVEYIKARTHLIRWVGLSRQKSNEVWKWEDGSVISENMFEFL
EDGKGNMNCAYFHNGKMHPTFCENKHYLMCERKAGMTKVDQLP

FIGURE 307

```
CCCACGCGTCCGCGCAGTCGCGCAGTTCTGCCTCCGCCTGCCAGTCTCGCCCGCGATCCCGG
CCCGGGGCTGTGGCGTCGACTCCGACCCAGGCAGCCAGCAGCCCGCGCGGGAGCCGGACCGC
CGCCGGAGGAGCTCGGACGGCATGCTGAGCCCCCTCCTTTGCTGAAGCCCGAGTGCGGAGAA
GCCCGGGCAAACGCAGGCTAAGGAGACCAAAGCGGCGAAGTCGCGAGACAGCGGACAAGCAG
CGGAGGAGAAGGAGGAGGAGGCGAACCCAGAGAGGGGCAGCAAAAGAAGCGGTGGTGGTGGG
CGTCGTGGCCATGGCGGCGGCTATCGCCAGCTCGCTCATCCGTCAGAAGAGGCAAGCCCGCG
AGCGCGAGAAATCCAACGCCTGCAAGTGTGTCAGCAGCCCCAGCAAAGGCAAGACCAGCTGC
GACAAAAACAAGTTAAATGTCTTTTCCCGGGTCAAACTCTTCGGCTCCAAGAAGAGGCGCAG
AAGAAGACCAGAGCCTCAGCTTAAGGGTATAGTTACCAAGCTATACAGCCGACAAGGCTACC
ACTTGCAGCTGCAGGCGGATGGAACCATTGATGGCACCAAAGATGAGGACAGCACTTACACT
CTGTTTAACCTCATCCCTGTGGGTCTGCGAGTGGTGGCTATCCAAGGAGTTCAAACCAAGCT
GTACTTGGCAATGAACAGTGAGGGATACTTGTACACCTCGGAACTTTTCACACCTGAGTGCA
AATTCAAAGAATCAGTGTTTGAAAATTATTATGTGACATATTCATCAATGATATACCGTCAG
CAGCAGTCAGGCCGAGGGTGGTATCTGGGTCTGAACAAAGAAGGAGAGATCATGAAAGGCAA
CCATGTGAAGAAGAACAAGCCTGCAGCTCATTTTCTGCCTAAACCACTGAAAGTGGCCATGT
ACAAGGAGCCATCACTGCACGATCTCACGGAGTTCTCCCGATCTGGAAGCGGGACCCCAACC
AAGAGCAGAAGTGTCTCTGGCGTGCTGAACGGAGGCAAATCCATGAGCCACAATGAATCAAC
GTAGCCAGTGAGGGCAAAAGAAGGGCTCTGTAACAGAACCTTACCTCCAGGTGCTGTTGAAT
TCTTCTAGCAGTCCTTCACCCAAAAGTTCAAATTTGTCAGTGACATTTACCAAACAAACAGG
CAGAGTTCACTATTCTATCTGCCATTAGACCTTCTTATCATCCATACTAAAGC
```

FIGURE 308

></usr/seqdb2/sst/DNA/Dnaseqs.full/ss.DNA28498
><subunit 1 of 1, 245 aa, 1 stop
><MW: 27564, pI: 10.18, NX(S/T): 1
MAAAIASSLIRQKRQAREREKSNACKCVSSPSKGKTSCDKNKLNVFSRVKLFGSKKRRRRRP
EPQLKGIVTKLYSRQGYHLQLQADGTIDGTKDEDSTYTLFNLIPVGLRVVAIQGVQTKLYLA
MNSEGYLYTSELFTPECKFKESVFENYYVTYSSMIYRQQQSGRGWYLGLNKEGEIMKGNHVK
KNKPAAHFLPKPLKVAMYKEPSLHDLTEFSRSGSGTPTKSRSVSGVLNGGKSMSHNEST

N-glycosylation site.

amino acids 242-246

Glycosaminoglycan attachment site.

amino acids 165-169, 218-222

Tyrosine kinase phosphorylation site.

amino acids 93-100

N-myristoylation site.

amino acids 87-93, 231-237

ATP/GTP-binding site motif A (P-loop).

amino acids 231-239

HBGF/FGF family proteins amino acids 78-94, 102-153

FIGURE 309

CCAGGATGGAGCTGGGGCCTGTATAGCCATATTATTGTTCTATGCTACTAGACATGGGGGGG
ACTTGGTGAAAAAGGTATTATCCAGCCAGAGGGTCTGGGAGCCCTGTCTTACTGAACCTGGG
CAACCTGGATATTCTGAGACATATTTTGGGGGGATTTCAGTGAAAAAGTGGGGGATCCCCT
CCATTTAGAGTGTAGCAAAGGAAAAAACACCAAGGTTGGGTTCCTTCCTGACATTGGCAGTG
CCCCAGTAGGGGTGGGATGAGCGAATATTCCCAAAGCTAAAGTCCCACACCCTGTAGATTAC
AAGAGTGGATTTGGCAGGAGTGTGCCCCAAAATACAGTGGAAAGGTGCCTGAAGATATTTAA
ACCACGTCTTGGAAATTTAGTGGGTCTTGGCTTTGGGATAGGTGAAGTGAGGACAGACACTG
GAGAGGAGGGAAAGGGGACGTTTTCAATAGGAGGCAAAACTCGAGGGTGGGATCCACTGAGG
AGTACATAGGCTGCTGGATCTGGTGGAGCCAGCACTGGGCCCACGGGTGGTAACTGGCTGCT
GTGGAGGGGGGTACGTGAGGGGGGGTCTGGGGCTTATCCTCAGGTCCTGTGGGTGGGGCAG
CGAGTCGGGGCCTGAGCGTCAAGAGCATGCCCTAGTGAGCGGGCTCCTCTGGGGGAGCCCAG
CGCGCTCCGGGCGCCTGCCGGTTTGGGGGTGTCTCCTCCCGGGGCGCTATGGCGGCGCTGGC
CAGTAGCCTGATCCGGCAGAAGCGGGAGGTCCGCGAGCCCGGGGGCAGCCGGCCGGTGTCGG
CGCAGCGGCGCGTGTGTCCCCGCGGCACCAAGTCCCTTTGCCAGAAGCAGCTCCTCATCCTG
CTGTCCAAGGTGCGACTGTGCGGGGGCGGCCCGCGCGGCCGGACCGCGGCCCGGAGCCTCA
GCTCAAAGGCATCGTCACCAAACTGTTCTGCCGCCAGGGTTTCTACCTCCAGGCGAATCCCG
ACGGAAGCATCCAGGGCACCCCAGAGGATACCAGCTCCTTCACCCACTTCAACCTGATCCCT
GTGGGCCTCCGTGTGGTCACCATCCAGAGCGCCAAGCTGGGTCACTACATGGCCATGAATGC
TGAGGGACTGCTCTACAGTTCGCCGCATTTCACAGCTGAGTGTCGCTTTAAGGAGTGTGTCT
TTGAGAATTACTACGTCCTGTACGCCTCTGCTCTCTACCGCCAGCGTCGTTCTGGCCGGGCC
TGGTACCTCGGCCTGGACAAGGAGGGCCAGGTCATGAAGGGAAACCGAGTTAAGAAGACCAA
GGCAGCTGCCCACTTTCTGCCCAAGCTCCTGGAGGTGGCCATGTACCAGGAGCCTTCTCTCC
ACAGTGTCCCCGAGGCCTCCCCTTCCAGTCCCCCTGCCCCTGAAATGTAGTCCCTGGACTG
GAGGTTCCCTGCACTCCCAGTGAGCCAGCCACCACCACAACCTGT

FIGURE 310

MAALASSLIRQKREVREPGGSRPVSAQRRVCPRGTKSLCQKQLLILLSKVRLCGGRPARPDR
GPEPQLKGIVTKLFCRQGFYLQANPDGSIQGTPEDTSSFTHFNLIPVGLRVVTIQSAKLGHY
MAMNAEGLLYSSPHFTAECRFKECVFENYYVLYASALYRQRRSGRAWYLGLDKEGQVMKGNR
VKKTKAAAHFLPKLLEVAMYQEPSLHSVPEASPSSPPAP

Tyrosine kinase phosphorylation site:

amino acids 199-207

N-myristoylation sites:

amino acids 54-60, 89-95, 131-137

HBGF/FGF family signature:

amino acids 131-155

FIGURE 311

ATGGCCGCGGCCATCGCTAGCGGCTTGATCCGCCAGAAGCGGCAGGCGCGGGAGCAGCACTG
GGACCGGCCGTCTGCCAGCAGGAGGCGGAGCAGCCCCAGCAAGAACCGCGGGCTCTGCAACG
GCAACCTGGTGGATATCTTCTCCAAAGTGCGCATCTTCGGCCTCAAGAAGCGCAGGTTGCGG
CGCCAAGATCCCCAGCTCAAGGGTATAGTGACCAGGTTATATTGCAGGCAAGGCTACTACTT
GCAAATGCACCCCGATGGAGCTCTCGATGGAACCAAGGATGACAGCACTAATTCTACACTCT
TCAACCTCATACCAGTGGGACTACGTGTTGTTGCCATCCAGGGAGTGAAAACAGGGTTGTAT
ATAGCCATGAATGGAGAAGGTTACCTCTACCCATCAGAACTTTTTACCCCTGAATGCAAGTT
TAAAGAATCTGTTTTTGAAAATTATTATGTAATCTACTCATCCATGTTGTACAGACAACAGG
AATCTGGTAGAGCCTGGTTTTTGGGATTAAATAAGGAACGGCAAGCTATGAAAGGGAACAGA
GTAAAGAAAACCAAACCAGCAGCTCATTTTCTACCCAAGCCATTGGAAGTTGCCATGTACCG
AGAACCATCTTTGCATGATGTTGGGGAAACGGTCCCGAAGCCTGGGGTGACGCCAAGTAAAA
GCACAAGTGCGTCTGCAATAATGAATGGAGGCAAACCAGTCAACAAGAGTAAGACAACATAG

FIGURE 312

></usr/seqdb2/sst/DNA/Dnaseqs.min/ss.DNA28503
><subunit 1 of 1, 247 aa, 1 stop
><MW: 27702, pI: 10.36, NX(S/T): 2
MAAAIASGLIRQKRQAREQHWDRPSASRRRSSPSKNRGLCNGNLVDIFSKVRIFGLKKRRLR
RQDPQLKGIVTRLYCRQGYYLQMHPDGALDGTKDDSTNSTLFNLIPVGLRVVAIQGVKTGLY
IAMNGEGYLYPSELFTPECKFKESVFENYYVIYSSMLYRQQESGRAWFLGLNKEGQAMKGNR
VKKTKPAAHFLPKPLEVAMYREPSLHDVGETVPKPGVTPSKSTSASAIMNGGKPVNKSKTT

N-glycosylation site.

amino acids 100-104, 242-246 cAMP- and cGMP-dependent protein kinase phosphorylation site.

amino acids 28-32, 29-33

Tyrosine kinase phosphorylation site.

amino acids 199-207

N-myristoylation site.

amino acids 38-44, 89-95, 118-124, 122-128, 222-228

HBGF/FGF family proteins.

amino acids 104-155, 171-198

FIGURE 313

```
GGGGAGAGGAATTGACCATGTAAAAGGAGACTTTTTTTTTTGGTGGTGGTGGCTGTTGGGTGCCTTGCAAAAAT
GAAGGATGCAGGACGCAGCTTTCTCCTGGAACCGAACGCAATGGATAAACTGATTGTGCAAGAGAGAAGGAAGA
ACGAAGCTTTTTCTTGTGAGCCCTGGATCTTAACACAAATGTGTATATGTGCACACAGGGAGCATTCAAGAATG
AAATAAACCAGAGTTAGACCCGCGGGGGTTGGTGTGTTCTGACATAAATAAATAATCTTAAAGCAGCTGTTCCC
CTCCCCACCCCCAAAAAAAAGGATGATTGGAAATGAAGAACCGAGGATTCACAAAGAAAAAGTATGTTCATTT
TTCTCTATAAAGGAGAAAGTGAGCCAAGGAGATATTTTTGGAATGAAAAGTTTGGGGCTTTTTTAGTAAAGTAA
AGAACTGGTGTGGTGGTGTTTTCCTTTCTTTTTGAATTTCCCACAAGAGGAGAGGAAATTAATAATACATCTGC
AAAGAAATTTCAGAGAAGAAAAGTTGACCGCGGCAGATTGAGGCATTGATTGGGGAGAGAAACCAGCAGAGCA
CAGTTGGATTTGTGCCTATGTTGACTAAAATTGACGGATAATTGCAGTTGGATTTTTCTTCATCAACCTCCTTT
TTTTTAAATTTTTATTCCTTTTGGTATCAAGATCATGCGTTTTCTCTTGTTCTTAACCACCTGGATTTCCATCT
GGATGTTGCTGTGATCAGTCTGAAATACAACTGTTTGAATTCCAGAAGGACCAACACCAGATAAATTATGAATG
TTGAACAAGATGACCTTACATCCACAGCAGATAATGATAGGTCCTAGGTTTAACAGGGCCCTATTTGACCCCCT
GCTTGTGGTGCTGCTGGCTCTTCAACTTCTTGTGGTGGCTGGTCTGGTGCGGGCTCAGACCTGCCCTTCTGTGT
GCTCCTGCAGCAACCAGTTCAGCAAGGTGATTTGTGTTCGGAAAAACCTGCGTGAGGTTCCGGATGGCATCTCC
ACCAACACACGGCTGCTGAACCTCCATGAGAACCAAATCCAGATCATCAAAGTGAACAGCTTCAAGCACTTGAG
GCACTTGGAAATCCTACAGTTGAGTAGGAACCATATCAGAACCATTGAAATTGGGGCTTTCAATGGTCTGGCGA
ACCTCAACACTCTGGAACTCTTTGACAATCGTCTTACTACCATCCCGAATGGAGCTTTTGTATACTTGTCTAAA
CTGAAGGAGCTCTGGTTGCGAAACAACCCCATTGAAAGCATCCCTTCTTATGCTTTTAACAGAATTCCTTCTTT
GCGCCGACTAGACTTAGGGGAATTGAAAAGACTTTCATACATCTCAGAAGGTGCCTTTGAAGGTCTGTCCAACT
TGAGGTATTTGAACCTTGCCATGTGCAACCTTCGGGAAATCCCTAACCTCACACCGCTCATAAAACTAGATGAG
CTGGATCTTTCTGGGAATCATTTATCTGCCATCAGGCCTGGCTCTTTCCAGGGTTTGATGCACCTTCAAAAACT
GTGGATGATACAGTCCCAGATTCAAGTGATTGAACGGAATGCCTTTGACAACCTTCAGTCACTAGTGGAGATCA
ACCTGGCACACAATAATCTAACATTACTGCCTCATGACCTCTTCACTCCCTTGCATCATCTAGAGCGGATACAT
TTACATCACAACCCTTGGAACTGTAACTGTGACATACTGTGGCTCAGCTGGTGGATAAAAGACATGGCCCCCTC
GAACACAGCTTGTTGTGCCCGGTGTAACACTCCTCCCAATCTAAAGGGGAGGTACATTGGAGAGCTCGACCAGA
ATTACTTCACATGCTATGCTCCGGTGATTGTGGAGCCCCCTGCAGACCTCAATGTCACTGAAGGCATGGCAGCT
GAGCTGAAATGTCGGGCCTCCACATCCCTGACATCTGTATCTTGGATTACTCCAAATGGAACAGTCATGACACA
TGGGGCGTACAAAGTGCGGATAGCTGTGCTCAGTGATGGTACGTTAAATTTCACAAATGTAACTGTGCAAGATA
CAGGCATGTACACATGTATGGTGAGTAATTCCGTTGGGAATACTACTGCTTCAGCCACCCTGAATGTTACTGCA
GCAACCACTACTCCTTTCTCTTACTTTTCAACCGTCACAGTAGAGACTATGGAACCGTCTCAGGATGAGGCACG
GACCACAGATAACAATGTGGGTCCCACTCCAGTGGTCGACTGGGAGACCACCAATGTGACCACCTCTCTCACAC
CACAGAGCACAAGGTCGACAGAGAAAACCTTCACCATCCCAGTGACTGATATAAACAGTGGGATCCCAGGAATT
GATGAGGTCATGAAGACTACCAAAATCATCATTGGGTGTTTTGTGGCCATCACACTCATGGCTGCAGTGATGCT
GGTCATTTTCTACAAGATGAGGAAGCAGCACCATCGGCAAAACCATCACGCCCAACAAGGACTGTTGAAATTA
TTAATGTGGATGATGAGATTACGGGAGACACACCCATGGAAAGCCACCTGCCCATGCCTGCTATCGAGCATGAG
CACCTAAATCACTATAACTCATACAAATCTCCCTTCAACCACACAACAACAGTTAACACAATAAATTCAATACA
CAGTTCAGTGCATGAACCGTTATTGATCCGAATGAACTCTAAAGACAATGTACAAGAGACTCAAATCTAAAACA
TTTACAGAGTTACAAAAAACAAACAATCAAAAAAAAAGACAGTTTATTAAAAATGACACAAATGACTGGGCTAA
ATCTACTGTTTCAAAAAAGTGTCTTTACAAAAAAACAAAAAGAAAAGAAATTTATTTATTAAAAATTCTATTG
TGATCTAAAGCAGACAAAAA
```

FIGURE 314

MLNKMTLHPQQIMIGPRFNRALFDPLLVVLLALQLLVVAGLVRAQTCPSVCSCSNQFSKVIC
VRKNLREVPDGISTNTRLLNLHENQIQIIKVNSFKHLRHLEILQLSRNHIRTIEIGAFNGLA
NLNTLELFDNRLTTIPNGAFVYLSKLKELWLRNNPIESIPSYAFNRIPSLRRLDLGELKRLS
YISEGAFEGLSNLRYLNLAMCNLREIPNLTPLIKLDELDLSGNHLSAIRPGSFQGLMHLQKL
WMIQSQIQVIERNAFDNLQSLVEINLAHNNLTLLPHDLFTPLHHLERIHLHHNPWNCNCDIL
WLSWWIKDMAPSNTACCARCNTPPNLKGRYIGELDQNYFTCYAPVIVEPPADLNVTEGMAAE
LKCRASTSLTSVSWITPNGTVMTHGAYKVRIAVLSDGTLNFTNVTVQDTGMYTCMVSNSVGN
TTASATLNVTAATTTPFSYFSTVTVETMEPSQDEARTTDNNVGPTPVVDWETTNVTTSLTPQ
STRSTEKTFTIPVTDINSGIPGIDEVMKTTKIIIGCFVAITLMAAVMLVIFYKMRKQHHRQN
HHAPTRTVEIINVDDEITGDTPMESHLPMPAIEHEHLNHYNSYKSPFNHTTTVNTINSIHSS
VHEPLLIRMNSKDNVQETQI

Signal sequence:

amino acids 1-44

Transmembrane domain:

amino acids 523-543

N-glycosylation site.

amino acids 278-282, 364-368, 390-394, 412-416, 415-419, 434-438, 442-446, 488-492, 606-610 cAMP- and cGMP-dependent protein kinase phosphorylation site.

amino acids 183-187

Casein kinase II phosphorylation site.

amino acids 268-272, 417-421, 465-469, 579-583, 620-624

N-myristoylation site.

amino acids 40-46, 73-79, 118-124, 191-197, 228-234, 237-243, 391-397, 422-428, 433-439, 531-537

FIGURE 315

```
GCGCCGGGAGCCCATCTGCCCCCAGGGGCACGGGGCGCGGGGCCGGCTCCCGCCCGGCACAT
GGCTGCAGCCACCTCGCGCGCACCCCGAGGCGCCGCGCCCAGCTCGCCCGAGGTCCGTCGGA
GGCGCCCGGCCGCCCCGGAGCCAAGCAGCAACTGAGCGGGGAAGCGCCCGCGTCCGGGGATC
GGGATGTCCCTCCTCCTTCTCCTCTTGCTAGTTTCCTACTATGTTGGAACCTTGGGGACTCA
CACTGAGATCAAGAGAGTGGCAGAGGAAAAGGTCACTTTGCCCTGCCACCATCAACTGGGGC
TTCCAGAAAAAGACACTCTGGATATTGAATGGCTGCTCACCGATAATGAAGGGAACCAAAAA
GTGGTGATCACTTACTCCAGTCGTCATGTCTACAATAACTTGACTGAGGAACAGAAGGGCCG
AGTGGCCTTTGCTTCCAATTTCCTGGCAGGAGATGCCTCCTTGCAGATTGAACCTCTGAAGC
CCAGTGATGAGGGCCGGTACACCTGTAAGGTTAAGAATTCAGGGCGCTACGTGTGGAGCCAT
GTCATCTTAAAAGTCTTAGTGAGACCATCCAAGCCCAAGTGTGAGTTGGAAGGAGAGCTGAC
AGAAGGAAGTGACCTGACTTTGCAGTGTGAGTCATCCTCTGGCACAGAGCCCATTGTGTATT
ACTGGCAGCGAATCCGAGAGAAAGAGGGAGAGGATGAACGTCTGCCTCCCAAATCTAGGATT
GACTACAACCACCCTGGACGAGTTCTGCTGCAGAATCTTACCATGTCCTACTCTGGACTGTA
CCAGTGCACAGCAGGCAACGAAGCTGGGAAGGAAAGCTGTGTGGTGCGAGTAACTGTACAGT
ATGTACAAAGCATCGGCATGGTTGCAGGAGCAGTGACAGGCATAGTGGCTGGAGCCCTGCTG
ATTTTCCTCTTGGTGTGGCTGCTAATCCGAAGGAAAGACAAAGAAAGATATGAGGAAGAAGA
GAGACCTAATGAAATTCGAGAAGATGCTGAAGCTCCAAAAGCCCGTCTTGTGAAACCCAGCT
CCTCTTCCTCAGGCTCTCGGAGCTCACGCTCTGGTTCTTCCTCCACTCGCTCCACAGCAAAT
AGTGCCTCACGCAGCCAGCGGACACTGTCAACTGACGCAGCACCCCAGCCAGGGCTGGCCAC
CCAGGCATACAGCCTAGTGGGGCCAGAGGTGAGAGGTTCTGAACCAAAGAAAGTCCACCATG
CTAATCTGACCAAAGCAGAAACCACACCCAGCATGATCCCCAGCCAGAGCAGAGCCTTCCAA
ACGGTCTGAATTACAATGGACTTGACTCCCACGCTTTCCTAGGAGTCAGGGTCTTTGGACTC
TTCTCGTCATTGGAGCTCAAGTCACCAGCCACACAACCAGATGAGAGGTCATCTAAGTAGCA
GTGAGCATTGCACGGAACAGATTCAGATGAGCATTTTCCTTATACAATACCAAACAAGCAAA
AGGATGTAAGCTGATTCATCTGTAAAAAGGCATCTTATTGTGCCTTTAGACCAGAGTAAGGG
AAAGCAGGAGTCCAAATCTATTTGTTGACCAGGACCTGTGGTGAGAAGGTTGGGGAAAGGTG
AGGTGAATATACCTAAAACTTTTAATGTGGGATATTTGTATCAGTGCTTTGATTCACAATT
TTCAAGAGGAAATGGGATGCTGTTTGTAAATTTTCTATGCATTTCTGCAAACTTATTGGATT
ATTAGTTATTCAGACAGTCAAGCAGAACCCACAGCCTTATTACACCTGTCTACACCATGTAC
TGAGCTAACCACTTCTAAGAAACTCCAAAAAAGGAAACATGTGTCTTCTATTCTGACTTAAC
TTCATTTGTCATAAGGTTTGGATATTAATTTCAAGGGGAGTTGAAATAGTGGGAGATGGAGA
AGAGTGAATGAGTTTCTCCCACTCTATACTAATCTCACTATTTGTATTGAGCCCAAAATAAC
TATGAAAGGAGACAAAAATTTGTGACAAAGGATTGTGAAGAGCTTTCCATCTTCATGATGTT
ATGAGGATTGTTGACAAACATTAGAAATATATAATGGAGCAATTGTGGATTTCCCTCAAAT
CAGATGCCTCTAAGGACTTTCCTGCTAGATATTCTGGAAGGAGAAATACAACATGTCATT
TATCAACGTCCTTAGAAAGAATTCTTCTAGAGAAAAGGGATCTAGGAATGCTGAAAGATTA
CCCAACATACCATTATAGTCTCTTCTTTCTGAGAAAATGTGAAACCAGAATTGCAAGACTGG
GTGGACTAGAAAGGGAGATTAGATCAGTTTTCTCTTAATATGTCAAGGAAGGTAGCCGGGCA
TGGTGCCAGGCACCTGTAGGAAAATCCAGCAGGTGGAGGTTGCAGTGAGCCGAGATTATGCC
ATTGCACTCCAGCCTGGGTGACAGAGCGGGACTCCGTCTC
```

FIGURE 316

></usr/seqdb2/sst/DNA/Dnaseqs.min/ss.DNA45419
><subunit 1 of 1, 373 aa, 1 stop
><MW: 41281, pI: 8.33, NX(S/T): 3
MSLLLLLLLVSYYVGTLGTHTEIKRVAEEKVTLPCHHQLGLPEKDTLDIEWLLTDNEGNQKV
VITYSSRHVYNNLTEEQKGRVAFASNFLAGDASLQIEPLKPSDEGRYTCKVKNSGRYVWSHV
ILKVLVRPSKPKCELEGELTEGSDLTLQCESSSGTEPIVYYWQRIREKEGEDERLPPKSRID
YNHPGRVLLQNLTMSYSGLYQCTAGNEAGKESCVVRVTVQYVQSIGMVAGAVTGIVAGALLI
FLLVWLLIRRKDKERYEEEERPNEIREDAEAPKARLVKPSSSSSGSRSSRSGSSSTRSTANS
ASRSQRTLSTDAAPQPGLATQAYSLVGPEVRGSEPKKVHHANLTKAETTPSMIPSQSRAFQTV

Signal sequence:

amino acids 1-16

Transmembrane domain:

amino acids 232-251

FIGURE 317

```
CGCGAGGCGCGGGAGCCTGGGACCAGGAGCGAGAGCCGCCTACCTGCAGCCGCCGCCCACGGCACGGCAGCCA
CCATGGCGCTCCTGCTGTGCTTCGTGCTCCTGTGCGGAGTAGTGGATTTCGCCAGAAGTTTGAGTATCACTACT
CCTGAAGAGATGATTGAAAAAGCCAAGGGGAAACTGCCTATCTGCCATGCAAATTTACGCTTAGTCCCGAAGA
CCAGGGACCGCTGGACATCGAGTGGCTGATATCACCAGCTGATAATCAGAAGGTGGATCAAGTGATTATTTTAT
ATTCTGGAGACAAAATTTATGATGACTACTATCCAGATCTGAAAGGCCGAGTACATTTTACGAGTAATGATCTC
AAATCTGGTGATGCATCAATAAATGTAACGAATTTACAACTGTCAGATATTGGCACATATCAGTGCAAAGTGAA
AAAAGCTCCTGGTGTTGCAAATAAGAAGATTCATCTGGTAGTTCTTGTTAAGCCTTCAGGTGCGAGATGTTACG
TTGATGGATCTGAAGAAATTGGAAGTGACTTTAAGATAAAATGTGAACCAAAAGAAGGTTCACTTCCATTACAG
TATGAGTGGCAAAAATTGTCTGACTCACAGAAAATGCCCACTTCATGGTTAGCAGAAATGACTTCATCTGTTAT
ATCTGTAAAAAATGCCTCTTCTGAGTACTCTGGGACATACAGCTGTACAGTCAGAAACAGAGTGGGCTCTGATC
AGTGCCTGTTGCGTCTAAACGTTGTCCCTCCTTCAAATAAAGCTGGACTAATTGCAGGAGCCATTATAGGAACT
TTGCTTGCTCTAGCGCTCATTGGTCTTATCATCTTTTGCTGTCGTAAAAAGCGCAGAGAAGAAAAATATGAAAA
GGAAGTTCATCACGATATCAGGGAAGATGTGCCACCTCCAAAGAGCCGTACGTCCACTGCCAGAAGCTACATCG
GCAGTAATCATTCATCCCTGGGGTCCATGTCTCCTTCCAACATGGAAGGATATTCCAAGACTCAGTATAACCAA
GTACCAAGTGAAGACTTTGAACGCACTCCTCAGAGTCCGACTCTCCCACCTGCTAAGTTCAAGTACCCTTACAA
GACTGATGGAATTACAGTTGTATAAATATGGACTACTGAAGAATCTGAAGTATTGTATTATTTGACTTTATTTT
AGGCCTCTAGTAAAGACTTAAATGTTTTTAAAAAAAGCACAAGGCACAGAGATTAGAGCAGCTGTAAGAACAC
ATCTACTTTATGCAATGGCATTAGACATGTAAGTCAGATGTCATGTCAAAATTAGTACGAGCCAAATTCTTTGT
TAAAAAACCCTATGTATAGTGACACTGATAGTTAAAAGATGTTTTATTATATTTTCAATAACTACCACTAACAA
ATTTTTAACTTTTCATATGCATATTCTGATATGTGGTCTTTTAGGAAAAGTATGGTTAATAGTTGATTTTTCAA
AGGAAATTTTAAAATTCTTACGTTCTGTTTAATGTTTTTGCTATTTAGTTAAATACATTGAAGGGAAATACCCG
TTCTTTTCCCCTTTTATGCACACAACAGAAACACGCGTTGTCATGCCTCAAACTATTTTTTATTTGCAACTACA
TGATTTCACACAATTCTCTTAAACAACGACATAAAATAGATTTCCTTGTATATAAATAACTTACATACGCTCCA
TAAAGTAAATTCTCAAAGGTGCTAGAACAAATCGTCCACTTCTACAGTGTTCTCGTATCCAACAGAGTTGATGC
ACAATATATAAATACTCAAGTCCAATATTAAAAACTTAGGCACTTGACTAACTTTAATAAAATTTCTCAAACTA
TATCAATATCTAAAGTGCATATATTTTTTAAGAAAGATTATTCTCAATAACTTCTATAAAAATAAGTTTGATGG
TTTGGCCCATCTAACTTCACTACTATTAGTAAGAACTTTTAACTTTTAATGTGTAGTAAGGTTTATTCTACCTT
TTTCTCAACATGACACCAACACAATCAAAAACGAAGTTAGTGAGGTGCTAACATGTGAGGATTAATCCAGTGAT
TCCGGTCACAATGCATTCCAGGAGGAGGTACCCATGTCACTGGAATTGGGCGATATGGTTTATTTTTTCTTCCC
TGATTTGGATAACCAAATGGAACAGGAGGAGGATAGTGATTCTGATGGCCATTCCCTCGATACATTCCTGGCTT
TTTTCTGGGCAAAGGGTGCCACATTGGAAGAGGTGGAAATATAAGTTCTGAAATCTGTAGGGAAGAGAACACAT
TAAGTTAATTCAAAGGAAAAAATCATCATCTATGTTCCAGATTTCTCATTAAAGACAAAGTTACCCACAACACT
GAGATCACATCTAAGTGACACTCCTATTGTCAGGTCTAAATACATTAAAAACCTCATGTGTAATAGGCGTATAA
TGTATAACAGGTGACCAATGTTTTCTGAATGCATAAAGAAATGAATAAACTCAAACACAGTACTTCCTAAACAA
CTTCAACCAAAAAAGACCAAAACATGGAACGAATGGAAGCTTGTAAGGACATGCTTGTTTTAGTCCAGTGGTTT
CCACAGCTGGCTAAGCCAGGAGTCACTTGGAGGCTTTTAAATACAAAACATTGGAGCTGGAGGCCATTATCCTT
AGCAAACTAATGCAGAAACAGAAATCAACTACCGCATGTTCTCACTTATAAGTGGGAGGTAATGATAAGAACT
TATGAACACAAAGAAGGAAACAATAGACATTGGAGTCTATTTGAGAGGGGAGGGTGGGAGAAGGAAAAGGAGCA
GAAAAGATAACTATTGAGTACTGCCTTCACACCTGGGTGATGAAATAATATGTACAACAAATCCCTGTGACACA
TGTTTACCTATGGAACAAACCTTCATGTGTATCCCTAAACCTAAAATAAAGTTAAAAAAAAAAAAARAAAAAA
AAAAAAAAAAAAAAAAAAAAAAAAAAAAAAAAAAAAAAAAAAAAAAAAAAAAAAAAAAAAAAAAAAAAAAAAAA
AAAAAAAAAAAAAAAAAAAAAAAA
```

FIGURE 318

></usr/seqdb2/sst/DNA/Dnaseqs.full/ss.DNA82361
><subunit 1 of 1, 352 aa, 1 stop
><MW: 38938, pI: 7.86, NX(S/T): 3
MALLLCFVLLCGVVDFARSLSITTPEEMIEKAKGETAYLPCKFTLSPEDQGPLDIEWLISPA
DNQKVDQVIILYSGDKIYDDYYPDLKGRVHFTSNDLKSGDASINVTNLQLSDIGTYQCKVKK
APGVANKKIHLVVLVKPSGARCYVDGSEEIGSDFKIKCEPKEGSLPLQYEWQKLSDSQKMPT
SWLAEMTSSVISVKNASSEYSGTYSCTVRNRVGSDQCLLRLNVVPPSNKAGLIAGAIIGTLL
ALALIGLIIFCCRKKRREEKYEKEVHHDIREDVPPPKSRTSTARSYIGSNHSSLGSMSPSNM
EGYSKTQYNQVPSEDFERTPQSPTLPPAKFKYPYKTDGITVV

Signal sequence.

amino acids 1-19

Transmembrane domain:

amino acids 236-257

N-glycosylation sites.

amino acids 106-110, 201-205, 298-302

Tyrosine kinase phosphorylation sites.

amino acids 31-39, 78-85, 262-270

N-myristoylation sites.

amino acids 116-122, 208-214, 219-225, 237-243, 241-247, 245-251, 296-302

Myelin P0 protein.

amino acids 96-125

FIGURE 319

```
TGAAATGACTTCCACGGCTGGGACGGGAACCTTCCACCCACAGCTATGCCTCTGATTGGTGA
ATGGTGAAGGTGCCTGTCTAACTTTTCTGTAAAAAGAACCAGCTGCCTCCAGGCAGCCAGCC
CTCAAGCATCACTTACAGGACCAGAGGGACAAGACATGACTGTGATGAGGAGCTGCTTTCGC
CAATTTAACACCAAGAAGAATTGAGGCTGCTTGGGAGGAAGGCCAGGAGGAACACGAGACTG
AGAGATGAATTTTCAACAGAGGCTGCAAAGCCTGTGGACTTTAGCCAGACCCTTCTGCCCTC
CTTTGCTGGCGACAGCCTCTCAAATGCAGATGGTTGTGCTCCCTTGCCTGGGTTTTACCCTG
CTTCTCTGGAGCCAGGTATCAGGGGCCCAGGGCCAAGAATTCCACTTTGGGCCCTGCCAAGT
GAAGGGGGTTGTTCCCCAGAAACTGTGGGAAGCCTTCTGGGCTGTGAAAGACACTATGCAAG
CTCAGGATAACATCACGAGTGCCCGGCTGCTGCAGCAGGAGGTTCTGCAGAACGTCTCGGAT
GCTGAGAGCTGTTACCTTGTCCACACCCTGCTGGAGTTCTACTTGAAAACTGTTTTCAAAAA
CCACCACAATAGAACAGTTGAAGTCAGGACTCTGAAGTCATTCTCTACTCTGGCCAACAACT
TTGTTCTCATCGTGTCACAACTGCAACCCAGTCAAGAAAATGAGATGTTTTCCATCAGAGAC
AGTGCACACAGGCGGTTTCTGCTATTCCGGAGAGCATTCAAACAGTTGGACGTAGAAGCAGC
TCTGACCAAAGCCCTTGGGGAAGTGGACATTCTTCTGACCTGGATGCAGAAATTCTACAAGC
TCTGAATGTCTAGACCAGGACCTCCCTCCCCCTGGCACTGGTTTGTTCCCTGTGTCATTTCA
AACAGTCTCCCTTCCTATGCTGTTCACTGGACACTTCACGCCCTTGGCCATGGGTCCCATTC
TTGGCCCAGGATTATTGTCAAAGAAGTCATTCTTTAAGCAGCGCCAGTGACAGTCAGGGAAG
GTGCCTCTGGATGCTGTGAAGAGTCTACAGAAGATTCTTGTATTTATTACAACTCTATTT
AATTAATGTCAGTATTTCAACTGAAGTTCTATTTATTTGTGAGACTGTAAGTTACATGAAGG
CAGCAGAATATTGTGCCCCATGCTTCTTTACCCCTCACAATCCTTGCCACAGTGTGGGCAG
TGGATGGGTGCTTAGTAAGTACTTAATAAACTGTGGTGCTTTTTTGGCCTGTCTTTGGATT
GTTAAAAAACAGAGAGGGATGCTTGGATGTAAAACTGAACTTCAGAGCATGAAAATCACACT
GTCTTCTGATATCTGCAGGGACAGAGCATTGGGGTGGGGTAAGGTGCATCTGTTTGAAAAG
TAAACGATAAAATGTGGATTAAAGTGCCCAGCACAAAGCAGATCCTCAATAAACATTTCATT
TCCCACCCACACTCGCCAGCTCACCCCATCATCCCTTTCCCTTGGTGCCCTCCTTTTTTTTT
TATCCTAGTCATTCTTCCCTAATCTTCCACTTGAGTGTCAAGCTGACCTTGCTGATGGTGAC
ATTGCACCTGGATGTACTATCCAATCTGTGATGACATTCCCTGCTAATAAAAGACAACATAA
CTCCAAAAAAAAAAAAAAAAAAAAAAAAAAA
```

FIGURE 320

></usr/seqdb2/sst/DNA/Dnaseqs.full/ss.DNA88002
><subunit 1 of 1, 206 aa, 1 stop
><MW: 23799, pI: 9.12, NX(S/T): 3

MNFQQRLQSLWTLARPFCPPLLATASQMQMVVLPCLGFTLLLWSQVSGAQGQEFHFGPCQVK
GVVPQKLWEAFWAVKDTMQAQDNITSARLLQQEVLQNVSDAESCYLVHTLLEFYLKTVFKNH
HNRTVEVRTLKSFSTLANNFVLIVSQLQPSQENEMFSIRDSAHRRFLLFRRAFKQLDVEAAL
TKALGEVDILLTWMQKFYKL

Signal sequence:

amino acids 1-42

N-glycosylation sites.

amino acids 85-89, 99-103, 126-130

FIGURE 321

AAGGAGCAGCCCGCAAGCACCAAGTGAGAGGCATGAAGTTACAGTGTGTTTCCCTTTGGCTC
CTGGGTACAATACTGATATTGTGCTCAGTAGACAACCACGGTCTCAGGAGATGTCTGATTTC
CACAGACATGCACCATATAGAAGAGAGTTTCCAAGAAATCAAAAGAGCCATCCAAGCTAAGG
ACACCTTCCCAAATGTCACTATCCTGTCCACATTGGAGACTCTGCAGATCATTAAGCCCTTA
GATGTGTGCTGCGTGACCAAGAACCTCCTGGCGTTCTACGTGGACAGGGTGTTCAAGGATCA
TCAGGAGCCAAACCCCAAAATCTTGAGAAAAATCAGCAGCATTGCCAACTCTTTCCTCTACA
TGCAGAAAACTCTGCGGCAATGTCAGGAACAGAGGCAGTGTCACTGCAGGCAGGAAGCCACC
AATGCCACCAGAGTCATCCATGACAACTATGATCAGCTGGAGGTCCACGCTGCTGCCATTAA
ATCCCTGGGAGAGCTCGACGTCTTTCTAGCCTGGATTAATAAGAATCATGAAGTAATGTTCT
CAGCTTGATGACAAGGAACCTGTATAGTGATCCAGGGATGAACACCCCTGTGCGGTTTACT
GTGGGAGACAGCCCACCTTGAAGGGGAAGGAGATGGGGAAGGCCCCTTGCAGCTGAAAGTCC
CACTGGCTGGCCTCAGGCTGTCTTATTCCGCTTGAAAATAGGCAAAAAGTCTACTGTGGTAT
TTGTAATAAACTCTATCTGCTGAAAGGGCCTGCAGGCCATCCTGGGAGTAAAGGGCTGCCTT
CCCATCTAATTTATTGTAAAGTCATATAGTCCATGTCTGTGATGTGAGCCAAGTGATATCCT
GTAGTACACATTGTACTGAGTGGTTTTTCTGAATAAATTCCATATTTTACCTATGA

FIGURE 322

></usr/seqdb2/sst/DNA/Dnaseqs.full/ss.DNA92282
><subunit 1 of 1, 177 aa, 1 stop
><MW: 20452, pI: 8.00, NX(S/T): 2
MKLQCVSLWLLGTILILCSVDNHGLRRCLISTDMHHIEESFQEIKRAIQAKDTFPNVTILST
LETLQIIKPLDVCCVTKNLLAFYVDRVFKDHQEPNPKILRKISSIANSFLYMQKTLRQCQEQ
RQCHCRQEATNATRVIHDNYDQLEVHAAAIKSLGELDVFLAWINKNHEVMFSA

Signal sequence:

amino acids 1-18

N-glycosylation sites.

amino acids 56-60, 135-139 cAMP- and cGMP-dependent protein kinase phosphorylation site.

amino acids 102-106

N-myristoylation site.

amino acids 24-30

Actinin-type actin-binding domain signature 1.

amino acids 159-169

FIGURE 323

CCCGTGCCAAGAGTGACGTAAGTACCGCCTATAGAGTCTATAGGCCCACTTGGCTTCGTTAG
AACGCGGCTACAATTAATACATAACCTTATGTATCATACACATACGATTTAGGTGACACTAT
AGAATAACATCCACTTTGCCTTTCTCTCCACAGGTGTCCACTCCCAGGTCCAACTGCACCTC
GGTTCTATCGATAATCTCAGCACCAGCCACTCAGAGCAGGGCACGATGTTGGGGGCCCGCCT
CAGGCTCTGGGTCTGTGCCTTGTGCAGCGTCTGCAGCATGAGCGTCCTCAGAGCCTATCCCA
ATGCCTCCCACTGCTCGGCTCCAGCTGGGGTGGCCTGATCCACCTGTACACAGCCACAGCC
AGGAACAGCTACCACCTGCAGATCCACAAGAATGGCCATGTGGATGGCGCACCCCATCAGAC
CATCTACAGTGCCCTGATGATCAGATCAGAGGATGCTGGCTTTGTGGTGATTACAGGTGTGA
TGAGCAGAAGATACCTCTGCATGGATTTCAGAGGCAACATTTTTGGATCACACTATTTCGAC
CCGGAGAACTGCAGGTTCCAACACCAGACGCTGGAAAACGGGTACGACGTCTACCACTCTCC
TCAGTATCACTTCCTGGTCAGTCTGGGCCGGGCGAAGAGAGCCTTCCTGCCAGGCATGAACC
CACCCCGTACTCCCAGTTCCTGTCCCGGAGGAACGAGATCCCCCTAATTCACTTCAACACC
CCCATACCACGGCGGCACACCCGGAGCGCCGAGGACGACTCGGAGCGGGACCCCCTGAACGT
GCTGAAGCCCCGGGCCCGGATGACCCCGGCCCCGGCCTCCTGTTCACAGGAGCTCCCGAGCG
CCGAGGACAACAGCCCGATGGCCAGTGACCCATTAGGGGTGGTCAGGGGCGGTCGAGTGAAC
ACGCACGCTGGGGGAACGGGCCCGGAAGGCTGCCGCCCCTTCGCCAAGTTCATCTAGGGTCG
CTGG

FIGURE 324

></usr/seqdb2/sst/DNA/Dnaseqs.min/ss.DNA142238
><subunit 1 of 1, 251 aa, 1 stop
><MW: 27954, pI: 9.22, NX(S/T): 1
MLGARLRLWVCALCSVCSMSVLRAYPNASPLLGSSWGGLIHLYTATARNSYHLQIHKNGHVD
GAPHQTIYSALMIRSEDAGFVVITGVMSRRYLCMDFRGNIFGSHYFDPENCRFQHQTLENGY
DVYHSPQYHFLVSLGRAKRAFLPGMNPPPYSQFLSRRNEIPLIHFNTPIPRRHTRSAEDDSE
RDPLNVLKPRARMTPAPASCSQELPSAEDNSPMASDPLGVVRGGRVNTHAGGTGPEGCRPFA
KFI

Important features of the protein:

Signal peptide:

amino acids 1-24 cAMP- and cGMP-dependent protein kinase phosphorylation site.

amino acids 175-179

N-myristoylation site.

amino acids 33-39, 100-106, 225-231, 229-235

HBGF/FGF family proteins amino acids 73-124

FIGURE 325

```
GGAAAAGGTACCCGCGAGAGACAGCCAGCAGTTCTGTGGAGCAGCGGTGGCCGGCTAGGATG
GGCTGTCTCTGGGGTCTGGCTCTGCCCCTTTTCTTCTTCTGCTGGGAGGTTGGGGTCTCTGG
GAGCTCTGCAGGCCCCAGCACCCGCAGAGCAGACACTGCGATGACAACGGACGACACAGAAG
TGCCCGCTATGACTCTAGCACCGGGCCACGCCGCTCTGGAAACTCAAACGCTGAGCGCTGAG
ACCTCTTCTAGGGCCTCAACCCCAGCCGGCCCCATTCCAGAAGCAGAGACCAGGGGAGCCAA
GAGAATTTCCCCTGCAAGAGAGACCAGGAGTTTCACAAAAACATCTCCCAACTTCATGGTGC
TGATCGCCACCTCCGTGGAGACATCAGCCGCCAGTGGCAGCCCCGAGGGAGCTGGAATGACC
ACAGTTCAGACCATCACAGGCAGTGATCCCGAGGAAGCCATCTTTGACACCCTTTGCACCGA
TGACAGCTCTGAAGAGGCAAAGACACTCACAATGGACATATTGACATTGGCTCACACCTCCA
CAGAAGCTAAGGGCCTGTCCTCAGAGAGCAGTGCCTCTTCCGACGGCCCCCATCCAGTCATC
ACCCCGTCACGGGCCTCAGAGAGCAGCGCCTCTTCCGACGGCCCCCATCCAGTCATCACCCC
GTCACGGGCCTCAGAGAGCAGCGCCTCTTCCGACGGCCCCCATCCAGTCATCACCCCGTCAT
GGTCCCCGGGATCTGATGTCACTCTCCTCGCTGAAGCCCTGGTGACTGTCACAAACATCGAG
GTTATTAATTGCAGCATCACAGAAATAGAAACAACAACTTCCAGCATCCCTGGGGCCTCAGA
CATAGATCTCATCCCCACGGAAGGGGTGAAGGCCTCGTCCACCTCCGATCCACCAGCTCTGC
CTGACTCCACTGAAGCAAAACCACACATCACTGAGGTCACAGCCTCTGCCGAGACCCTGTCC
ACAGCCGGCACCACAGAGTCAGCTGCACCTCATGCCACGGTTGGGACCCCACTCCCCACTAA
CAGCGCCACAGAAGAGAAGTGACAGCACCCGGGGCCACGACCCTCAGTGGAGCTCTGGTCA
CAGTTAGCAGGAATCCCCTGGAAGAAACCTCAGCCCTCTCTGTTGAGACACCAAGTTACGTC
AAAGTCTCAGGAGCAGCTCCGGTCTCCATAGAGGCTGGGTCAGCAGTGGGCAAAACAACTTC
CTTTGCTGGGAGCTCTGCTTCCTCCTACAGCCCCTCGGAAGCCGCCCTCAAGAACTTCACCC
CTTCAGAGACACCGACCATGGACATCGCAACCAAGGGGCCCTTCCCCACCAGCAGGGACCCT
CTTCCTTCTGTCCCTCCGACTACAACCAACAGCAGCCGAGGGACGAACAGCACCTTAGCCAA
GATCACAACCTCAGCGAAGACCACGATGAAGCCCCAACAGCCACGCCCACGACTGCCCGGAC
GAGGCCGACCACAGACGTGAGTGCAGGTGAAAATGGAGGTTTCCTCCTCCTGCGGCTGAGTG
TGGCTTCCCCGGAAGACCTCACTGACCCCAGAGTGGCAGAAAGGCTGATGCAGCAGCTCCAC
CGGGAACTCCACGCCCACGCGCCTCACTTCCAGGTCTCCTTACTGCGTGTCAGGAGAGGCTA
ACGGACATCAGCTGCAGCCAGGCATGTCCCGTATGCCAAAAGAGGGTGCTGCCCCTAGCCTG
GGCCCCCACCGACAGACTGCAGCTGCGTTACTGTGCTGAGAGGTACCCAGAAGGTTCCCATG
AAGGGCAGCATGTCCAAGCCCCTAACCCCAGATGTGGCAACAGGACCCTCGCTCACATCCAC
CGGAGTGTATGTATGGGGAGGGGCTTCACCTGTTCCCAGAGGTGTCCTTGGACTCACCTTGG
CACATGTTCTGTGTTTCAGTAAAGAGAGACCTGATCACCCATCTGTGTGCTTCCATCCTGCA
TTAAAATTCACTCAGTGTGGCCCAAAAAAAA
```

FIGURE 326

MGCLWGLALPLFFFCWEVGVSGSSAGPSTRRADTAMTTDDTEVPAMTLAPGHAALETQTLSA
ETSSRASTPAGPIPEAETRGAKRISPARETRSFTKTSPNFMVLIATSVETSAASGSPEGAGM
TTVQTITGSDPEEAIFDTLCTDDSSEEAKTLTMDILTLAHTSTEAKGLSSESSASSDGPHPV
ITPSRASESSASSDGPHPVITPSRASESSASSDGPHPVITPSWSPGSDVTLLAEALVTVTNI
EVINCSITEIETTTSSIPGASDIDLIPTEGVKASSTSDPPALPDSTEAKPHITEVTASAETL
STAGTTESAAPHATVGTPLPTNSATEREVTAPGATTLSGALVTVSRNPLEETSALSVETPSY
VKVSGAAPVSIEAGSAVGKTTSFAGSSASSYSPSEAALKNFTPSETPTMDIATKGPFPTSRD
PLPSVPPTTTNSSRGTNSTLAKITTSAKTTMKPQQPRPRLPGRGRPQT

N-glycosylation sites:

amino acids 252-256, 445-449, 451-455 cAMP-and cGMP-dependent protein kinase phosphorylation site.

amino acids 84-90

Casein kinase II phosphorylation sites.

amino acids 37-41, 108-112, 131-135, 133-137, 148-152, 165-169, 246-250, 254-258, 256-260, 269-273, 283-287, 333-337, 335-339, 404-408, 414-418, 431-435

N-myristoylation sites.

amino acids 2-8, 19-25, 117-123, 121-127, 232-238, 278-284, 314-320, 349-355, 386-392, 397-403, 449-455

ATP/GTP-binding site motif A (P-loop).

amino acids 385-393

FIGURE 327

```
GCGGAGCATCCGCTGCGGTCCTCGCCGAGACCCCGCGCGGATTCGCCGGTCCTTCCCGCGG
GCGCGACAGAGCTGTCCTCGCACCTGGATGGCAGCAGGGGCGCCGGGGTCCTCTCGACGCCA
GAGAGAAATCTCATCATCTGTGCAGCCTTCTTAAAGCAAACTAAGACCAGAGGGAGGATTAT
CCTTGACCTTTGAAGACCAAAACTAAACTGAAATTTAAAATGTTCTTCGGGGGAGAAGGGAG
CTTGACTTACACTTTGGTAATAATTTGCTTCCTGACACTAAGGCTGTCTGCTAGTCAGAATT
GCCTCAAAAAGAGTCTAGAAGATGTTGTCATTGACATCCAGTCATCTCTTTCTAAGGGAATC
AGAGGCAATGAGCCCGTATACTTCAACTCAAGAAGACTGCATTAATTCTTGCTGTTCAAC
AAAAAACATATCAGGGGACAAAGCATGTAACTTGATGATCTTCGACACTCGAAAACAGCTA
GACAACCCAACTGCTACCTATTTTTCTGTCCCAACGAGGAAGCCTGTCCATTGAAACCAGCA
AAAGGACTTATGAGTTACAGGATAATTACAGATTTTCCATCTTTGACCAGAAATTTGCCAAG
CCAAGAGTTACCCCAGGAAGATTCTCTCTTACATGGCCAATTTTCACAAGCAGTCACTCCCC
TAGCCCATCATCACACAGATTATTCAAAGCCCACCGATATCTCATGGAGAGACACACTTTCT
CAGAAGTTTGGATCCTCAGATCACCTGGAGAAACTATTTAAGATGGATGAAGCAAGTGCCCA
GCTCCTTGCTTATAAGGAAAAGGCCATTCTCAGAGTTCACAATTTTCCTCTGATCAAGAAA
TAGCTCATCTGCTGCCTGAAAATGTGAGTGCGCTCCCAGCTACGGTGGCAGTTGCTTCTCCA
CATACCACCTCGGCTACTCCAAAGCCGCCACCCTTCTACCCACCAATGCTTCAGTGACACC
TTCTGGGACTTCCCAGCCACAGCTGGCCACCACAGCTCCACCTGTAACCACTGTCACTTCTC
AGCCTCCCACGACCCTCATTTCTACAGTTTTTACACGGGCTGCGGCTACACTCCAAGCAATG
GCTACAACAGCAGTTCTGACTACCACCTTTCAGGCACCTACGGACTCGAAAGGCAGCTTAGA
AACCATACCGTTTACAGAAATCTCCAACTTAACTTTGAACACAGGGAATGTGTATAACCCTA
CTGCACTTTCTATGTCAAATGTGGAGTCTTCCACTATGAATAAAACTGCTTCCTGGGAAGGT
AGGGAGGCCAGTCCAGGCAGTTCCTCCCAGGGCAGTGTTCCAGAAAATCAGTACGGCCTTCC
ATTTGAAAAATGGCTTCTTATCGGGTCCCTGCTCTTTGGTGTCCTGTTCCTGGTGATAGGCC
TCGTCCTCCTGGGTAGAATCCTTTCGGAATCACTCCGCAGGAAACGTTACTCAAGACTGGAT
TATTTGATCAATGGGATCTATGTGGACATCTAAGGATGGAACTCGGTGTCTCTTAATTCATT
TAGTAACCAGAAGCCCAAATGCAATGAGTTTCTGCTGACTTGCTAGTCTTAGCAGGAGGTTG
TATTTTGAAGACAGGAAAATGCCCCCTTCTGCTTTCCTTTTTTTTTGGAGACAGAGTCTT
GCTCTGTTGCCCAGGCTGGAGTGCAGTAGCACGATCTCGGCTCTCACCGCAACCTCCGTCTC
CTGGGTTCAAGCGATTCTCCTGCCTCAGCCTCCTAAGTATCTGGGATTACAGGCATGTGCCA
CCACACCTGGGTGATTTTTGTATTTTTAGTAGAGACGGGGTTTCACCATGTTGGTCAGGCTG
GTCTCAAACTCCTGACCTAGTGATCCACCCTCCTCGGCCTCCCAAAGTGCTGGGATTACAGG
CATGAGCCACCACAGCTGGCCCCTTCTGTTTTATGTTTGGTTTTGAGAAGGAATGAAGTG
GGAACCAAATTAGGTAATTTTGGGTAATCTGTCTCTAAATATTAGCTAAAACAAAGCTCT
ATGTAAAGTAATAAAGTATAATTGCCATATAAATTTCAAATTCAACTGGCTTTTATGCAAA
GAAACAGGTTAGGACATCTAGGTTCCAATTCATTCACATTCTTGGTTCCAGATAAAATCAAC
TGTTTATATCAATTTCTAATGGATTTGCTTTTCTTTTTATATGGATTCCTTTAAAACTTATT
CCAGATGTAGTTCCTTCCAATTAAATATTTGAATAAATCTTTTGTTACTCAA
```

FIGURE 328

\></usr/seqdb2/sst/DNA/Dnaseqs.min/ss.DNA45410
\><subunit 1 of 1, 431 aa, 1 stop
\><MW: 46810, pI: 6.45, NX(S/T): 6

MFFGGEGSLTYTLVIICFLTLRLSASQNCLKKSLEDVVIDIQSSLSKGIRGNEPVYTSTQED
CINSCCSTKNISGDKACNLMIFDTRKTARQPNCYLFFCPNEEACPLKPAKGLMSYRIITDFP
SLTRNLPSQELPQEDSLLHGQFSQAVTPLAHHHTDYSKPTDISWRDTLSQKFGSSDHLEKLF
KMDEASAQLLAYKEKGHSQSSQFSSDQEIAHLLPENVSALPATVAVASPHTTSATPKPATLL
PTNASVTPSGTSQPQLATTAPPVTTVTSQPPTTLISTVFTRAAATLQAMATTAVLTTTFQAP
TDSKGSLETIPFTEISNLTLNTGNVYNPTALSMSNVESSTMNKTASWEGREASPGSSSQGSV
PENQYGLPFEKWLLIGSLLFGVLFLVIGLVLLGRILSESLRRKRYSRLDYLINGIYVDI

Signal sequence.

amino acids 1-25

Transmembrane domain.

amino acids 384-405

N-glycosylation sites.

amino acids 72-76, 222-226, 251-255, 327-331, 352-356 cAMP- and cGMP-dependent protein kinase phosphorylation site.

amino acids 415-419

Tyrosine kinase phosphorylation site.

amino acids 50-57

N-myristoylation sites.

amino acids 4-10, 48-54, 315-321

FIGURE 329

```
CTCCCACGGTGTCCAGCGCCCAGAATGCGGCTTCTGGTCCTGCTATGGGGTTGCCTGCTGCT
CCCAGGTTATGAAGCCCTGGAGGGCCCAGAGGAAATCAGCGGGTTCGAAGGGGACACTGTGT
CCCTGCAGTGCACCTACAGGGAAGAGCTGAGGGACCACCGGAAGTACTGGTGCAGGAAGGGT
GGGATCCTCTTCTCTCGCTGCTCTGGCACCATCTATGCAGAAGAAGAAGGCCAGGAGACAAT
GAAGGGCAGGGTGTCCATCCGTGACAGCCGCCAGGAGCTCTCGCTCATTGTGACCCTGTGGA
ACCTCACCCTGCAAGACGCTGGGGAGTACTGGTGTGGGGTCGAAAAACGGGGCCCCGATGAG
TCTTTACTGATCTCTCTGTTCGTCTTTCCAGGACCCTGCTGTCCTCCCTCCCCTTCTCCCAC
CTTCCAGCCTCTGGCTACAACACGCCTGCAGCCCAAGGCAAAAGCTCAGCAAACCCAGCCCC
CAGGATTGACTTCTCCTGGGCTCTACCCGGCAGCCACCACAGCCAAGCAGGGGAAGACAGGG
GCTGAGGCCCCTCCATTGCCAGGGACTTCCCAGTACGGGCACGAAAGGACTTCTCAGTACAC
AGGAACCTCTCCTCACCCAGCGACCTCTCCTCCTGCAGGGAGCTCCCGCCCCCCCATGCAGC
TGGACTCCACCTCAGCAGAGGACACCAGTCCAGCTCTCAGCAGTGGCAGCTCTAAGCCCAGG
GTGTCCATCCCGATGGTCCGCATACTGGCCCCAGTCCTGGTGCTGCTGAGCCTTCTGTCAGC
CGCAGGCCTGATCGCCTTCTGCAGCCACCTGCTCCTGTGGAGAAAGGAAGCTCAACAGGCCA
CGGAGACACAGAGGAACGAGAAGTTCTGGCTCTCACGCTTGACTGCGGAGGAAAAGGAAGCC
CCTTCCCAGGCCCCTGAGGGGACGTGATCTCGATGCCTCCCCTCCACACATCTGAGGAGGA
GCTGGGCTTCTCGAAGTTTGTCTCAGCGTAGGGCAGGAGGCCCTCCTGGCCAGGCCAGCAGT
GAAGCAGTATGGCTGGCTGGATCAGCACCGATTCCCGAAAGCTTTCCACCTCAGCCTCAGAG
TCCAGCTGCCCGGACTCCAGGGCTCTCCCCACCCTCCCCAGGCTCTCCTCTTGCATGTTCCA
GCCTGACCTAGAAGCGTTTGTCAGCCCTGGAGCCCAGAGCGGTGGCCTTGCTCTTCCGGCTG
GAGACTGGGACATCCCTGATAGGTTCACATCCCTGGGCAGAGTACCAGGCTGCTGACCCTCA
GCAGGGCCAGACAAGGCTCAGTGGATCTGGTCTGAGTTTCAATCTGCCAGGAACTCCTGGGC
CTCATGCCCAGTGTCGGACCCTGCCTTCCTCCCACTCCAGACCCCACCTTGTCTTCCCTCCC
TGGCGTCCTCAGACTTAGTCCCACGGTCTCCTGCATCAGCTGGTGATGAAGAGGAGCATGCT
GGGGTGAGACTGGGATTCTGGCTTCTCTTTGAACCACCTGCATCCAGCCCTTCAGGAAGCCT
GTGAAAACGTGATTCCTGGCCCCACCAAGACCCACCAAAACCATCTCTGGGCTTGGTGCAG
GACTCTGAATTCTAACAATGCCCAGTGACTGTCGCACTTGAGTTTGAGGGCCAGTGGGCCTG
ATGAACGCTCACACCCCTTCAGCTTAGAGTCTGCATTTGGGCTGTGACGTCTCCACCTGCCC
CAATAGATCTGCTCTGTCTGCGACACCAGATCCACGTGGGGACTCCCCTGAGGCCTGCTAAG
TCCAGGCCTTGGTCAGGTCAGGTGCACATTGCAGGATAAGCCCAGGACCGGCACAGAAGTGG
TTGCCTTTNCCATTTGCCCTCCCTGGNCCATGCCTTCTTGCCTTTGGAAAAAATGATGAAGA
AAACCTTGGCTCCTTCCTTGTCTGGAAAGGGTTACTTGCCTATGGGTTCTGGTGGCTAGAGA
GAAAGTAGAAAACCAGAGTGCACGTAGGTGTCTAACACAGAGGAGAGTAGGAACAGGGCGG
ATACCTGAAGGTGACTCCGAGTCCAGCCCCTGGAGAAGGGGTCGGGGGTGGTGGTAAAGTA
GCACAACTACTATTTTTTTTCTTTTTCCATTATTATTGTTTTTTAAGACAGAATCTCGTGCT
GCTGCCCAGGCTGGAGTGCAGTGGCACGATCTGCAAACTCCGCCTCCTGGGTTCAAGTGATT
CTTCTGCCTCAGCCTCCCGAGTAGCTGGGATTACAGGCACGCACCACCACACCTGGCTAATT
TTTGTACTTTTAGTAGAGATGGGGTTTCACCATGTTGGCCAGGCTGGTCTTGAACTCCTGAC
CTCAAATGAGCCTCCTGCTTCAGTCTCCCAAATTGCCGGGATTACAGGCATGAGCCACTGTG
TCTGGCCCTATTTCCTTTAAAAAGTGAAATTAAGAGTTGTTCAGTATGCAAAACTTGGAAAG
ATGGAGGAGAAAAGAAAAGGAAGAAAAAAATGTCACCCATAGTCTCACCAGAGACTATCAT
TATTTCGTTTTGTTGTACTTCCTTCCACTCTTTTCTTCTTCACATAATTTGCCGGTGTTCTT
TTTACAGAGCAATTATCTTGTATATACAACTTTGTATCCTGCCTTTTCCACCTTATCGTTCC
ATCACTTTATTCCAGCACTTCTCTGTGTTTTACAGACCTTTTTATAAATAAATGTTCATCA
GCTGCATAAAAAAAAAAAAAAA
```

FIGURE 330

</usr/seqdb2/sst/DNA/Dnaseqs.min/ss.DNA44196
<subunit 1 of 1, 332 aa, 1 stop
<MW: 36143, pI: 5.89, NX(S/T): 1
MRLLVLLWGCLLLPGYEALEGPEEISGFEGDTVSLQCTYREELRDHRKYWCRKGGILFSRCS
GTIYAEEEGQETMKGRVSIRDSRQELSLIVTLWNLTLQDAGEYWCGVEKRGPDESLLISLFV
FPGPCCPPSPSPTFQPLATTRLQPKAKAQQTQPPGLTSPGLYPAATTAKQGKTGAEAPPLPG
TSQYGHERTSQYTGTSPHPATSPPAGSSRPPMQLDSTSAEDTSPALSSGSSKPRVSIPMVRI
LAPVLVLLSLLSAAGLIAFCSHLLLWRKEAQQATETQRNEKFWLSRLTAEEKEAPSQAPEGD
VISMPPLHTSEEELGFSKFVSA

Important features:

Signal peptide:

amino acids 1-17

Transmembrane domain:

amino acids 248-269

N-glycosylation site.

amino acids 96-99

Fibrinogen beta and gamma chains C-terminal domain.

amino acids 104-113

Ig like V-type domain:

amino acids 13-128

SECRETED AND TRANSMEMBRANE POLYPEPTIDES AND NUCLEIC ACIDS ENCODING THE SAME

RELATED APPLICATIONS

This application is a continuation of, and claims priority under 35 USC §120 to, U.S. application Ser. No. 09/941,992 filed Aug. 28, 2001, which is a continuation of, and claims priority under 35 USC §120 to, PCT Application PCT/US00/08439 filed Mar. 30, 2000, which claims priority under 35 USC §119 to U.S. Provisional Application 60/141,037 filed Jun. 23, 1999, where PCT/US00/08439 is a continuation-in-part of, and claims priority under 35 USC §120 to, U.S. application Ser. No. 09/380,137 filed Aug. 25, 1999, which is the National Stage filed under 35 USC §371 of PCT Application PCT/US99/12252 filed Jun. 2, 1999, which claims priority under 35 USC §119 to U.S. Provisional Application 60/089,600 filed Jun. 17, 1998.

FIELD OF THE INVENTION

The present invention relates generally to the identification and isolation of novel DNA and to the recombinant production of novel polypeptides.

BACKGROUND OF THE INVENTION

Extracellular proteins play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108–7113 (1996); U.S. Pat. No. 5,536,637)].

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Efforts are being undertaken by both industry and academia to identify new, native receptor or membrane-bound proteins. Many efforts are focused on the screening of mammalian recombinant DNA libraries to identify the coding sequences for novel receptor or membrane-bound proteins.

1. PRO281

A novel gene designated testis enhanced gene transcript (TEGT) has recently been identified in humans (Walter et al., *Genomics* 20:301–304 (1995)). Recent results have shown that TEGT protein is developmentally regulated in the mammalian testis and possesses a nuclear targeting motif that allows the protein to localize to the nucleus (Walter et al., *Mamm. Genome* 5:216–221 (1994)). As such, it is believed that the TEGT protein plays an important role in testis development. There is, therefore, substantial interest in identifying and characterizing novel polypeptides having homology to the TEGT protein. We herein describe the identification and characterization of novel polypeptides having homology to TEGT protein, designated herein as PRO281 polypeptides.

2. PRO276

Efforts are being undertaken by both industry and academia to identify new, native membrane-bound proteins. Many of these efforts are focused on the screening of mammalian recombinant DNA libraries to identity the coding sequences for novel membrane-bound proteins. We herein describe the identification and characterization of novel transmembrane polypeptides, designated herein as PRO276 polypeptides.

3. PRO189

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO189 polypeptides.

4. PRO190

Of particular interest are proteins having seven transmembrane domains (7TM), or more generally, all multiple transmembrane spanning proteins. Among multiple transmembrane spanning proteins are ion channels and transporters. Examples of transporters are the UDP-galactose transporter described in Ishida, et al., *J. Biochem.*, 120(6):1074–1078 (1996), and the CMP-sialic acid transporter described in Eckhardt, et al., *PNAS*, 93(15):7572–7576 (1996). We herein describe the identification and characterization of novel transmembrane polypeptides, designated herein as PRO190 polypeptides.

5. PRO341

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO341 polypeptides.

6. PRO180

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO180 polypeptides.

7. PRO194

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO194 polypeptides.

8. PRO203

Enzymatic proteins play important roles in the chemical reactions involved in the digestion of foods, the biosynthesis of macromolecules, the controlled release and utilization of chemical energy, and other processes necessary to sustain life. ATPases are a family of enzymes that play a variety of important roles, including energizing transport of ions and molecules, across cellular membranes. Transport mechanisms that employ ATPases often involve excluding xeno- and endobiotic toxins from the cellular environment, thereby protecting cells from toxicity of these compounds. Lu et al. report a detoxification mechanism where glutathione S-transferase (GST) catalyzes glutathionation of plant toxins, and a specific $Mg^{2+}$-ATPase is involved in the transport of the glutathione S-conjugates from the cytosol. Proc. Natl. Acad. Sci. USA 94(15):8243–8248 (1997). This study and others indicate the importance of the identification of ATPases, such as GST ATPases, and of novel proteins having sequence identity with ATPases.

More generally, and also of interest are novel membrane-bound proteins, including those which may be involved in the transport of ions and molecules across membranes. Membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

In light of the important physiological roles played by ATPases and membrane-bound proteins efforts are being undertaken by both industry and academia to identify new, native membrane-bound proteins, and proteins having sequence identity to ATPases. We herein describe the identification and characterization of novel polypeptides having sequence identity to GST ATPase, designated herein as PRO203 polypeptides.

9. PRO290

Of particular interest are novel proteins and nucleic acids which have sequence identity with known proteins and nucleic acids. Proteins of interest which are well known in the art include NTII-1, a nerve protein which facilitates regeneration, FAN, and beige. Beige, or bg, is a murine analog related to Chediak-Higashi Syndrome (CHS), a rare autosomal recessive disease in which neutrophils, monocytes and lymphocytes contain giant cytoplasmic granules. See Perou et al., *J. Biol. Chem.* 272(47):29790 (1997) and Barbosa et al., *Nature* 382:262 (1996).

We herein describe the identification and characterization of novel polypeptides having sequence identity to NTII-1, FAN and beige, designated herein as PRO290 polypeptides.

10. PRO874

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO194 polypeptides.

11. PRO710

In *Saccharomyces cerevisiae*, the chromatin structure of DNA replication origins changes as cells become competent for DNA replication, suggesting that G1 phase-specific association of replication factors with origin DNA regulates entry into S phase (Aparicio et al., *Cell* 91:59–69 (1997)). In fact, it has been shown that the initiation of DNA replication in *Saccharomyces cerevisiae* requires the protein product of the CDC45 gene which encodes a protein that stays at relatively constant levels throughout the cell cycle (Owens et al., *Proc. Natl. Acad. Sci USA* 94:12521–12526 (1997)). The CDC45 protein is part of a prereplication complex that may move with DNA replication forks in yeast. Given the obvious importance of the CDC45 protein in DNA replication, there is significant interest in identifying and characterizing novel polypeptides having homology to CDC45. We herein describe the identification and characterization of novel polypeptides having homology to the CDC45 protein, designated herein as PRO710 polypeptides.

12. PRO1151

The complement proteins comprise a large group of serum proteins some of which act in an enzymatic cascade, producing effector molecules involved in inflammation. The complement proteins are of particular importance in regulating movement and function of cells involved in inflammation. One of the complement proteins, C1q, has been shown to be involved in the recognition of microbial surfaces and antibody-antigen complexes in the classical pathway of complement (Shapiro et al., *Curr. Biol.* 8(6):335–338 (1998)).

Given the physiological importance of inflammation and related mechanisms in vivo and in the specific physiological activities of complement C1q protein, efforts are currently being undertaken to identify new, native proteins which share sequence similarity to the complement proteins. We herein describe the identification and characterization of novel polypeptides having homology to complement C1q protein, designated herein as PRO1151 polypeptides.

13. PRO1282

All proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglubular shape. These two features have been indicated as responsible for the protein-binding functions of proteins containing leucine-rich repeats. See, Kobe and Deisenhofer, *Trends Biochem. Sci.*, 19(10):415–421 (October 1994); Kobe and Deisenhofer, *Curr. Opin. Struct. Biol.*, 5(3):409–416 (1995).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome, Chlemetson, K. J., *Thromb. Haemost.* (Germany), 74(1):111–116 (July 1995), reporting that platelets have leucine rich repeats and Ruoslahti, E. I., et al., WO9110727-A by La Jolla Cancer Research Foundation reporting that decorin binding to transforming growth factorβ has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit of IGF (ALS) is also of interest in that it increases the half-life of IGF and is part of the IGF complex in vivo.

Another protein which has been reported to have leucine-rich repeats is the SLIT protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-A1 by Yale University. Of particular interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37):22522 (1996). Other studies reporting on the biological functions of proteins having leucine rich repeats include: Tayar, N., et al., *Mol. Cell Endocrinol.*, (Ireland), 125(1–2):65–70 (December 1996) (gonadotropin receptor involvement); Miura, Y., et al., *Nippon Rinsho* (Japan), 54(7):1784–1789 (July 1996) (apoptosis involvement); Harris, P. C., et al., *J. Am. Soc. Nephrol.*, 6(4):1125–1133 (October 1995) (kidney disease involvement).

Leucine rich repeat proteins are further discussed in Kajava, *J. Mol. Biol.*, 277(3):519–527 (1998), Nagasawa, et al., *Genomics*, 44(3):273–279 (1997), Bengtsson, *J. Biol. Chem.*, 270(43):25639–25644 (1995), Gaillard, et al., *Cell*, 65(7):1127–1141 (1991) and Ohkura and Yanagida, *Cell*, 64(1):149–157 (1991), all incorporated herein by reference.

Thus, due to all the reasons listed above, new members of the leucine rich repeat superfamily are of interest. On a more general level, all novel proteins are of interest. We herein describe the identification and characterization of novel leucine-rich repeat-containing polypeptides, designated herein as PRO1282 polypeptides.

14. PRO358

The cloning of the Toll gene of *Drosophila*, a maternal effect gene that plays a central role in the establishment of the embryonic dorsal-ventral pattern, has been reported by Hashimoto et al., *Cell* 52:269–279 (1988). The *Drosophila* Toll gene encodes an integral membrane protein with an extracytoplasmic domain of 803 amino acids and a cytoplasmic domain of 269 amino acids. The extracytoplasmic domain has a potential membrane-spanning segment, and contains multiple copies of a leucine-rich segment, a structural motif found in many transmembrane proteins. The Toll protein controls dorsal-ventral patterning in *Drosophila* embryos and activates the transcription factor Dorsal upon binding to its ligand Spätzle. (Morisato and Anderson, *Cell* 76:677–688 (1994)). In adult *Drosophila*, the Toll/Dorsal signaling pathway participates in the anti-fungal immune response. (Lenaitre et al., *Cell* 86:973–983 (1996)).

A human homologue of the *Drosophila* Toll protein has been described by Medzhitov et al., *Nature* 388:394–397 (1997). This human Toll, just as *Drosophila* Toll, is a type I transmembrane protein, with an extracellular domain consisting of 21 tandemly repeated leucine-rich motifs (leucine-rich region—LRR), separated by a non-LRR region, and a cytoplasmic domain homologous to the cytoplasmic domain of the human interleukin-1 (IL-1) receptor. A constitutively active mutant of the human Toll transfected into human cell lines was shown to be able to induce the activation of NF-κB and the expression of NF-κB-controlled genes for the inflammatory cytokines IL-1, IL-6 and IL-8, as well as the expression of the constimulatory molecule B7.1, which is required for the activation of native T cells. It has been suggested that Toll functions in vertebrates as a non-clonal receptor of the immune system, which can induce signals for activating both an innate and an adaptive immune response in vertebrates. The human Toll gene reported by Medzhitov et al., supra was most strongly expressed in spleen and peripheral blood leukocytes (PBL), and the authors suggested that its expression in other tissues may be due to the presence of macrophages and dendritic cells, in which it could act as an early-warning system for infection. The public GenBank database contains the following Toll sequences: Toll1 (DNAX# HSU88540-1, which is identical with the random sequenced full-length cDNA #HUMRSC786-1); Toll2 (DNAX# HSU88878-1); Toll3 (DNAX# HSU88879-1); and Toll4 (DNAX# HSU88880-1, which is identical with the DNA sequence reported by Medzhitov et al., supra). A partial Toll sequence (Toll5) is available from GenBank under DNAX# HSU88881-1.

Further human homologues of the *Drosophila* Toll protein, designated as Toll-like receptors (huTLRs1-5) were recently cloned and shown to mirror the topographic structure of the *Drosophila* counterpart (Rocket al., *Proc. Natl. Acad. Sci. USA* 95:588–593 [1998]). Overexpression of aconstitutively active mutant of one human TLR (Toll-protein homologue—Medzhitov et al., supra; TLR4—Rock et al., supra) leads to the activation of NF-κB and induction of the inflammatory cytokines and constimulatory molecules. Medzhitov et al., supra.

We herein describe the identification and characterization of novel polypeptides having homology to Toll, designated herein as PRO358 polypeptides.

15. PRO1310

Of interest are proteins related to carboxypeptidases. Various carboxypeptidases are described in the literature, i.e., Krause et al., *Immunol. Rev.* 161:119–127 (1998) and Leiter, *J. Endocrinol.* 155(2):211–214 (1997). We herein describe the identification and characterization of novel polypeptides having homology to a carboxypeptidase, designated herein as PRO1310 polypeptides.

16. PRO698

The extracellular mucous matrix of olfactory neuroepithelium is a highly organized structure in intimate contact with chemosensory cilia that house the olfactory transduction machinery. The major protein component of this extracellular matrix is olfactomedin, a glycoprotein that is expressed in olfactory neuroepithelium and which form intermolecular disulfide bonds so as to produce a polymer (Yokoe et al., *Proc. Natl. Acad. Sci. USA* 90:4655–4659 (1993), Bal et al., *Biochemistry* 32:1047–1053 (1993) and Snyder et al., *Biochemistry* 30:9143–9153 (1991)). It has been suggested that olfactomedin may influence the maintenance, growth or differentiation of chemosensory cilia on the apical dendrites of olfactory neurons. Given this important role, there is significant interest in identifying and characterizing novel polypeptides having homology to olfactomedin. We herein describe the identification and characterization of novel polypeptides having homology to olfactomedin protein, designated herein as PRO698 polypeptides.

17. PRO732

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides having sequence identity to the Diff33 protein, designated herein as PRO732 polypeptides.

18. PRO1120

Enzymatic proteins play important roles in the chemical reactions involved in the digestion of foods, the biosynthesis of macromolecules, the controlled release and utilization of chemical energy, and other processes necessary to sustain life. Sulfatases are a family of secreted enzymatic proteins that play a variety of important metabolic roles and thus are the subject of interest in research and industry (see, e.g., Sleat et al., *Biochem J.*, 324(Pt. 1):33–39 (1997)). Deficiencies of certain sulfatases have been implicated in various human disorders including Sanfilippo D syndrome (see, Litjens et al., *Biochem J.* 327(Pt 1):899–94 (1997); Leipprandt et al. *J. Inherit Metab. Dis.* 18(5):647–648 (1995); and Freeman et al. *Biochem J.* 282(pt2):605–614 (1992)). We herein describe the identification and characterization of novel polypeptides having sequence identity to sulfatase protein, designated herein as PRO1120 polypeptides.

19. PRO537

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO537 polypeptides.

20. PRO536

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO536 polypeptides.

21. PRO535

Isomerase proteins play many important physiological roles in the mammal. Many different types of isomerase proteins have been identified and characterized including, for example, protein disulfide isomerases and peptidyl-prolyl isomerases. It has been reported that many immunophilin proteins, i.e., proteins that serves as receptors for immunosuppressant drugs, exhibit peptidyl-prolyl isomerase activity in that they function to catalyze the interconversion of the cis and trans isomerase of peptide and protein substrates for immunophilin proteins. As such, there is significant interest in identifying and characterizing novel polypeptides having sequence similarity to peptidyl-prolyl isomerase proteins. We herein describe the identification and characterization of novel polypeptides having homology to a putative peptidyl-prolyl isomerase protein, designated herein as PRO535 polypeptides.

22. PRO718

Efforts are being undertaken by both industry and academia to identify new, native transmembrane proteins. Many of these efforts are focused on the screening of mammalian recombinant DNA libraries to identify the coding sequences for novel transmembrane proteins. We herein describe the identification and characterization of novel transmembrane polypeptides, designated herein as PRO718 polypeptides.

23. PRO872

Enzymatic proteins play important roles in the chemical reactions involved in the digestion of foods, the biosynthesis of macromolecules, the controlled release and utilization of chemical energy, and other processes necessary to sustain life. Dehydrogenases and desaturases are a family of enzymes that play a variety of important metabolic roles and thus are the subject of interest in research and industry (see Hable et al., *Mol. Gen. Genet.* 257(2):167–176 (1998); Schneider, C. et al., *Prot. Expr. Purif.* 10(2):175–179 (1997)). We herein describe the identification and characterization of novel polypeptides having sequence identity to dehydrogenase proteins, designated herein as PRO872 polypeptides.

24. PRO1063

Collagens constitute the most abundant proteins of the extracellular matrix (ECM) in mammalian organisms. Collagen and other macromolecules of the ECM are deposited by resident cells and organized into a three-dimensional meshwork. This ECM environment plays an essential role in guiding cell migration and in cell-to-cell communication during morphogenic processes. The restructuring of the ECM during remodeling occurs as a cooperative multistep process involving a localized degradation of existing macromolecules, rearrangement of the cytoskeleton, cell translocation, and deposition of new ECM components. Involved in this restructuring are enzymes such as collagenases and gelatinases which play important roles in the degradation of the ECM. In light of the obviously important roles played by the collagenase enzymes, there is substantial interest in identifying and characterizing novel polypeptides having homology to these proteins. We herein describe the identification and characterization of novel polypeptides having homology to human type IV collagenase protein, designated herein as PRO1063 polypeptides.

25. PRO619

Immunoglobulins are antibody molecules, the proteins that function both as receptors for antigen on the B-cell membrane and as the secreted products of the plasma cell. Like all antibody molecules, immunoglobulins perform two major functions: they bind specifically to an antigen and they participate in a limited number of biological effector functions. Therefore, new members of the Ig superfamily are always of interest.

Of particular interest are novel gene products associated with mu chains in immature B cells. Shirasawa, et al., *EMBO J.*, 12(5):1827–1834 (1993); Dul, et al., *Eur. J. Immunol.*, 26(4):906–913 (1996). Moreover, the molecular components and assembly of mu surrogate light chain complexes in pre-B cell lines are of interest. Ohnishi and Takemori, *J. Biol. Chem.*, 269(45):28347–28353 (1994); Bauer, et al., *Curr. Top. Microbiol.*, 137:130–135 (1988). Novel nucleic acids and peptides related to VpreB1, VpreB2 and VpreB3 by sequence identity are of particular interest. The assembly and manipulation of immunoglobulins can effect the entire industry related to antibodies and vaccines.

We herein describe the identification and characterization of novel polypeptides having homology to VpreB proteins, designated herein as PRO619 polypeptides.

26. PRO943

Fibroblast growth factor (FGF) proteins exhibit a variety of activities and act by binding to cell surface fibroblast growth factor receptors. Many different fibroblast growth factor receptors have been identified and characterized, including the fibroblast growth factor receptor-4, which has been shown to be a high affinity receptor for both acidic and basic FGF (Ron et al.,*J. Biol. Chem.* 268:5388–5394 (1993) and Stark et al., *Development* 113:641–651 (1991)). Given the obvious importance of the FGF family of proteins and the cell surface receptors to which they bind, there is significant interest in identifying novel polypeptides having homology to the FGF receptor family. We herein describe the identification and characterization of novel polypeptides having homology to the fibroblast growth factor receptor-4 protein, designated herein as PRO943 polypeptides.

27. PRO1188

The identification of nucleotide pyrophosphohydrolases has been of interest because of the potential roles these secreted molecules play in calcium pyrophosphate dihydrate (CPPD) deposition disease, arthritis, and other joint diseases (see Masuda et al. *J. Rheumatol.* (997) 24(8):1588–1594; and Terkeltaub et al., *Arthritis Rheum* (1998) 37(6):934–941). We herein describe the identification and characterization of novel polypeptides having homology to nucleotide pyrophosphohydrolases, designated herein as PRO1188 polypeptides.

28. PRO1133

Netrins are molecules that guide growing axons and that are strikingly similar in sequence and in function in flies, nematodes and vertebrates. Additionally, netrin receptors have been identified in all three animal groups and shown to have crucial, conserved roles in axon navigation. Netrins and their receptors are further described in the literature, i.e., Varela-Echavarria and Guthrie, *Genes Dev.*, 11(5):545–557 (1997); Guthrie, *Curr. Biol.*, 7(1):R6–R9 (1997); and Keynes and Cook, *Neuron*, 17(6):1031–1034 (1996). Due to their relation to neurons, netrins and their related proteins are of interest. Of particular interest are molecules having sequence identity or similarity with netrin. We herein describe the identification and characterization of novel polypeptides having homology to netrins, designated herein as PRO1133 polypeptides.

29. PRO784

Of interest are membrane-bound and receptor proteins involved in intracellular signaling, metabolism, transport, and other pathways. For example, membrane-bound proteins of the endoplasmic reticulum and golgi apparatus play important roles in the transport of proteins. The sec22 protein is an endoplasmic reticulum membrane-bound protein involved in fundamental membrane trafficking reactions where secretory products are routed from their site of synthesis to their final destination. The roles of sec22 in transport pathways have been reported by numerous investigators (see Tang et al., *Biochem Biophys Res Commun* 243(3):885–891 (1998); Hay et al., *J. Biol. Chem.* 271(10):5671–5679 (1996); and Newman et al., *Mol. Cell. Biol.* 10(7):3405–3414 (1990)). We herein describe the identification and characterization of novel polypeptides having homology to sec22, designated herein as PRO784 polypeptides.

30. PRO783

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO783 polypeptides.

31. PRO820

Immunoglobulin molecules play roles in many important mammalian physiological processes. The structure of immunoglobulin molecules has been extensively studied and it has been well documented that intact immunoglobulins possess distinct domains, one of which is the constant domain or $F_c$ region of the immunoglobulin molecule. The $F_c$ domain of an immunoglobulin, while not being directly involved in antigen recognition and binding, does mediate the ability of the immunoglobulin molecule, either uncomplexed or complexed with its respective antigen, to bind to $F_c$ receptors either circulating in the serum or on the surface of cells. The ability of an $F_c$ domain of an immunoglobulin to bind to an $F_c$ receptor molecule results in a variety of important activities, including for example, in mounting an immune response against unwanted foreign particles. Thus, molecules related to $F_c$ receptors are of interest. $F_c$ receptors are further described in Tominaga et al., *Biochem. Biophys. Res. Commun.*, 168(2):683–689 (1990); Zhang et al., *Immuno.*, 39(6):423–427 (1994). We herein describe the identification and characterization of novel polypeptides having homology to $F_c$ receptor, designated herein as PRO820 polypeptides.

32. PRO1080

The folding of proteins and the assembly of protein complexes within subcompartments of the eukaryotic cell is catalysed by different members of the Hsp70 protein family. The chaperone function of Hsp70 proteins in these events is regulated by members of the DnaJ-like protein family, which occurs through direct interaction of different Hsp70 and DnaJ-like protein pairs that appear to be specifically adapted to each other. The diversity of functions of DnaJ-like proteins using specific examples of DnaJ-Hsp70 interactions with polypeptides in yeast protein-biogenesis pathways is further described in Cyr et al., *Trends Biochem. Sci.*, 19(4):176–181 (1994). DnaJ proteins and their involvement in the binding of secretory precursor polypeptides to a translocon subcomplex and polypeptide translocation machinery in the yeast endoplasmic reticulum are further described in Lyman and Schekman, *Cell* 88(1):85–96 (1997) and Lyman and Schekman, *Experientia* 52(12):1042–1049 (1996), respectively. Thus, DnaJ proteins are of interest, as are proteins related to DnaJ proteins, particularly those having sequence identity with DnaJ proteins. We herein describe the identification and characterization of novel polypeptides having homology to DnaJ proteins, designated herein as PRO1080 polypeptides.

33. PRO1079

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1079 polypeptides.

34. PRO793

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO793 polypeptides.

35. PRO1016

Enzymatic proteins play important roles in the chemical reactions involved in the digestion of foods, the biosynthesis of macromolecules, the controlled release and utilization of chemical energy, and other processes necessary to sustain life. Acyltransferases are enzymes which acylate moieties. Acyl-glycerol-phosphate acyltransferases can act on lysophosphatidic acid as a substrate. The lysophosphatidic acid is converted to phophatidic acid and thus plays a role in forming phosphatidylethanolamine found in membranes. See, Brown, et al., *Plant Mol. Biol.*, 26(1):211–223 (1994). Thus, acyltransferases play an important role in the biosynthesis of molecules requiring acylation. We herein describe the identification and characterization of novel polypeptides having homology to acyltransferase proteins, designated herein as PRO1016 polypeptides.

36. PRO1013

Efforts are being undertaken by both industry and academia to identify new, native proteins. Many of these efforts are focused on the screening of mammalian recombinant DNA libraries to identify the coding sequences for novel proteins. We herein describe the identification and characterization of novel polypeptides, designated herein as PRO1013 polypeptides.

37. PRO937

The glypican family of heparan sulfate proteoglycans are major cell-surface proteoglycans of the developing nervous system. It is believed that members of the glypican family play a role in regulating cell cycle progression during the transition of proliferating neuronal progenitor cells to differentiated neurons. Lander et al. *Perspect Dev. Neurobiol* 3(4):347–358 (1996). It is likely that proteoglycans of the glypican family play other important roles in neural development (Lander et al., supra), and as well as other tissues, as glypican family members have also been found in the developing kidney (Watanabe et al. *J. Cell Biol.* 130(5):1207–1218 (1995)). Accordingly, the identification of new members of the glypican family of proteins is of interest in research and in industry.

Described herein is the identification and characterization of novel polypeptides having sequence identity with glypican family proteins, designated herein as PRO937 polypeptides.

38. PRO842

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO842 polypeptides.

39. PRO839

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO839 polypeptides.

40. PRO1180

Methyltransferase enzymes catalyze the transfer of methyl groups from a donor molecule to an acceptor molecule Methyltransferase enzymes play extremely important roles in a number of different biological processes including, for example, in the electron transport chain in the plasma membrane in prokaryotes and in the inner mitochondrial membrane in eukaryotic cells (see, e.g., Barkovich et al., *J. Biol. Chem.* 272:9182–9188 (1997), Dibrov et al., *J. Biol. Chem.* 272:9175–9181 (1997), Lee et al., *J. Bacteriol.* 179:1748–1754 (1997) and Marbois et al., *Arch. Biochem. Biophys.* 313:83–88 (1994)). Methyltransferase enzymes have been shown to be essential for the biosynthesis of ubiquinone (coenzyme Q) and menaquinone (vitamin K2), both of which are essential isoprenoid quinone components of the respiratory electron transport chain. Given the obvious importance of the methyltransferase enzymes, there is substantial interest in identifying novel polypeptide homologs of the methyltransferases. We herein describe the identification and characterization of a novel polypeptide having homology to methyltransferase enzymes, designated herein as PRO1180 polypeptides.

41. PRO1134

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1134 polypeptides.

42. PRO830

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO830 polypeptides.

43. PRO1115

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1115 polypeptides.

44. PRO1277

Efforts are being undertaken by both industry and academia to identify new, native proteins. Many efforts are focused on the screening of mammalian recombinant DNA libraries to identify the coding sequences for novel receptor and other proteins. Of interest is the identification of proteins that may play roles in various human disorders and dysfunction. For example, the identification of proteins of the ear and the functions they play in hearing may lead to an understanding of the causes of hearing loss and deafness. Coch-B2 is one such protein that has been found to be specifically expressed in the inner ear (cochlea). It has been characterized and studied for its possible role in hearing loss (Robertson et al. *Genomics* (1994) 23(1):52–50; Robertson et al. *Genomics* (1997) 46(3):345–354). We herein describe the identification and characterization of novel polypeptides having sequence identity to Coch-B2, designated herein as PRO1277 polypeptides.

45. PRO1135

Glycosylation is an important mechanism for modulating the physiochemical and biological properties of proteins in a stage- and tissue-specific manner. One of the important enzymes involved in glycosylation in *Saccharomyces cerevisiae* is alpha 1,2-mannosidase, an enzyme that catalyzes the conversion of Man9GlcNAc2 to Man8GlcNAc2 during the formation of N-linked oligosaccharides. The *Saccharomyces cerevisiae* alpha 1,2-mannosidase enzyme of is a member of the Class I alpha 1,2-mannosidases that are conserved from yeast to mammals. Given the important roles played by the alpha 1,2-mannosidases in glycosylation and the physiochemical activity regulated by glycosylation, there is significant interest in identifying novel polypeptides having homology to one or more mannosidases. We herein describe the identification and characterization of novel polypeptides having homology to alpha 1,2-mannosidase protein, designated herein as PRO1135 polypeptides.

46. PRO1114

Interferons (IFNs) encompass a large family of secreted proteins occurring in vertebrates. Although they were originally named for their antiviral activity, growing evidence supports a critical role for IFNs in cell growth and differentiation (Jaramillo et al., *Cancer Investigation* 13(3):327–338 (1995)). IFNs belong to a class of negative growth factors having the ability to inhibit the growth of a wide variety of cells with both normal and transformed phenotypes. IFN therapy has been shown to be beneficial in the treatment of human malignancies such as Karposi's sarcoma, chronic myelogenous leukemia, non-Hodgkin's lymphoma, and hairy cell leukemia as well as in the treatment of infectious diseases such as hepatitis B (Gamliel et al., *Scanning Microscopy* 2(1):485–492 (1988), Einhorn et al., *Med. Oncol. & Tumor Pharmacother.* 10:25–29 (1993), Ringenberg et al., *Missouri Medicine* 85(1):21–26 (1988), Saracco et al., *Journal of Gastroenterology and Hepatology* 10:668–673 (1995), Gonzalez-Mateos et al., *Hepato-Gastroenteroloy* 42:893–899 (1995) and Malaguarnera et al., *Pharmacotheray* 17(5):998–1005 (1997)).

Interferons can be classified into two major groups based upon their primary sequence. Type I interferons, IFN-α and IFN-β, are encoded by a superfamily of intronless genes consisting of the IFN-α gene family and a single IFN-β gene that are thought to have arisen from a common ancestral gene. Type I interferons may be produced by most cell types. Type II IFN, or IFN-γ, is restricted to lymphocytes (T cells and natural killer cells) and is stimulated by nonspecific T cell activators or specific antigens in vivo.

Although both type I and type II IFNs produce similar antiviral and antiproliferative effects, they act on distinct cell surface receptors, wherein the binding is generally species specific (Langer et al., *Immunol. Today* 9:393–400 (1988)). Both IFN-α and IFN-β bind competitively to the same high affinity type I receptor, whereas IFN-γ binds to a distinct type II receptor. The presence and number of IFN receptors on the surface of a cell does not generally reflect the sensitivity of the cell to IFN, although it is clear that the effects of the IFN protein is mediated through binding to a cell surface interferon receptor. As such, the identification and characterization of novel interferon receptor proteins is of extreme interest.

We herein describe the identification and characterization of novel interferon receptor polypeptides, designated herein as "PRO1114 interferon receptor" polypeptides. Thus, the PRO1114 polypeptides of the present invention represents a novel cell surface interferon receptor.

47. PRO828

Glutathione peroxidases are of interest because they play important roles in protection against risk of coronary disease, atherosclerosis, platelet hyperaggregation and synthesis of proaggregant and proinflammatory compounds. Glutathione peroxidases are involved in the reduction of hydrogen peroxides and lipid peroxides, which in turn regulate the activities of cyclooxygenase and lipooxygenase pathways. This ultimately influences the production of eicosanoids and modulates the balance between a proaggregatory and antiaggregatory state of platelets. These and other activities and functions of glutathione peroxidases are discussed in greater detail by Ursini et al., *Biomed. Environ. Sci* 10(2–3): 327–332 (1997); Vitoux et al., *Ann. Biol. Clin (Paris)* 54(5): 181–187 (1996); and Mirault et al., *Ann N.Y. Acad. Sci* 738: 104–115 (1994).

We herein describe the identification and characterization of novel polypeptides having sequence identity with glutathione peroxidases, designated herein as PRO828 polypeptides.

48. PRO1009

Long chain acyl-CoA synthetase converts free fatty acids to acyl-CoA esters. This synthetase has been reported to have interesting characteristics. Specifically, it has been reported that two boys having Alport syndrome, elliptocytosis and mental retardation carried a large deletion where long chain acyl-CoA synthetase 4 would have been located. Thus, the absence of this enzyme is believed to play a role in the development of mental retardation or other signs associated with Alport syndrome in the family. Piccini, et al., *Genomics*, 47(3):350–358 (1998). Moreover, it has been reported that an inhibitor of acyl coenzyme A synthetase, triacsin C, inhibits superoxide anion generation and degranulation by human neutrophils. Thus, it is suggested that there is a role for acyl-CoA esters in regulating activation of 02 generation and degranulation at the G protein or subsequent step(s). Korchak, et al., *J. Biol. Chem.*, 269(48):30281–30287 (1994). Long chain acyl-CoA synthetase is also briefly discussed in a report which describes very long chain acyl-CoA synthetase. Uchiyama, et al., *J. Biol. Chem.*, 271(48):30360 (1994). Thus, long chain acyl-CoA synthetase and particular novel polypeptides having sequence identity therewith are of interest.

We herein describe the identification and characterization of novel polypeptides having sequence identity with long chain acyl-CoA synthetase, designated herein as PRO1009 polypeptides.

49. PRO1007

Glycosylphosphatidylinositol (GPI) anchored proteoglycans are generally localized to the cell surface and are thus known to be involved in the regulation of responses of cells to numerous growth factors, cell adhesion molecules and extracellular matrix components. The metastasis-associated GPI-anchored protein (MAGPIAP) is one of these cell surface proteins which appears to be involved in metastasis. Metastasis is the form of cancer wherein the transformed or malignant cells are traveling and spreading the cancer from one site to another. Therefore, identifying the polypeptides related to metastasis and MAGPIAP is of interest.

We herein describe the identification and characterization of novel polypeptides having sequence identity with MAGPIAP, designated herein as PRO1007 polypeptides.

50. PRO1056

Mammalian cell membranes perform very important functions relating to the structural integrity and activity of various cells and tissues. Of particular interest in membrane physiology is the study of transmembrane ion channels which act to directly control a variety of physiological, pharmacological and cellular processes. Numerous ion channels have been identified including calcium (Ca), sodium (Na), chloride (Cl) and potassium (K) channels, each of which have been analyzed in detail to determine their roles in physiological processes in vertebrate and insect cells. These roles include such things as maintaining cellular homeostasis, intracellular signaling, and the like. Given the obvious importance of the ion channels, there is significant interest in identifying and characterizing novel polypeptides having homology to one or more ion channels. We herein describe the identification and characterization of novel polypeptides having homology to a chloride channel protein, designated herein as PRO1056 polypeptides.

51. PRO826

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO826 polypeptides.

52. PRO819

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO819 polypeptides.

53. PRO1006

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1006 polypeptides.

54. PRO1112

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1112 polypeptides.

55. PRO1074

Many membrane-bound enzymatic proteins play important roles in the chemical reactions involved in metabolism, including the biosynthesis of macromolecules, the controlled release and utilization of chemical energy, development of tissues, and other processes necessary to sustain life. Galactosyltransferases are a family of enzymes that play a variety of important metabolic roles and thus are the subject of interest in research and industry. Numerous references have been published on the identification of galactosyltransferases and the roles they play in cellular development, maintenance, and dysfunction.

We herein describe the identification and characterization of novel polypeptides having homology to galactosyltransferases, designated herein as PRO1074 polypeptides.

56. PRO1005

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1005 polypeptides.

57. PRO1073

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1073 polypeptides.

58. PRO1152

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1152 polypeptides.

59. PRO1136

PDZ domain-containing proteins assist formation of cell-cell junctions and localization of membrane protein receptors and ion channels (Daniels et al., *Nat. Struct. Biol.* 5:317–325 (1998) and Ullmer et al., *FEBS Lett.* 424:63–68 (1998)). PDZ domains interact with the C-terminal residues of a particular target membrane protein. Based on their binding specificities and sequence homologies, PDZ domains fall into two classes, class I and class II. In light of the obvious importance of the PDZ domain-containing proteins, there is significant interest in identifying novel polypeptides that have homology to those proteins. We herein describe the identification and characterization of novel polypeptides having homology to PDZ domain-containing proteins, designated herein as PRO1136 polypeptides.

60. PRO813

Surfactant proteins play extremely important biological roles in the mammalian pulmonary system. One mammalian protein that has been studied and well characterized is pulmonary surfactant-associated protein C. For example, Qanbar et al., *Am. J. Physiol.* 271:L572–L580 (1996) studied the effect of palmitoylation of pulmonary surfactant-associated protein C on the surface activity of phospholipid mixtures. Specifically, the authors demonstrated that palmitoylation of pulmonary surfactant-associated protein C greatly enhanced lipid respreading and film stability and, therefore, was extremely important for surfactant function. Given the obvious important roles played by surfactant protein in the mammalian organism, there is significant interest in identifying novel polypeptides having homology to one or more surfactant enzymes. We herein describe the identification and characterization of novel polypeptides having homology to pulmonary surfactant-associated protein, designated herein as PRO813 polypeptides.

61. PRO809

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO809 polypeptides.

62. PRO791

Of particular interest are novel proteins which have sequence identity with known proteins. For example, novel proteins having some sequence identity with the major histocompatibility complex (MHC) are of interest. The MHC complex is a region of multiple loci that play major roles in determining whether transplanted tissue will be accepted as self (histocompatible) or rejected as foreign (histoincompatible). Moreover, the MHC plays a central role in the development of both humoral and cell-mediated immune responses. There are class I, II and III MHC antigens, all known in the art. Class I antigens are glycoproteins expressed on the surface of nearly all nucleated cells, where they present peptide antigens of altered self-cells necessary for the activation of Tc cells. The assembly of MHC class I antigens is further described in Kvist and Levy, *Semin. Immunol.*, 5(2):105–116 (1993) and Maffei, et al., *Hum. Immunol.*, 54(2):91–103 (1997).

We herein describe the identification and characterization of novel polypeptides having sequence identity to various MHC-I antigens, designated herein as PRO791 polypeptides.

63. PRO1004

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1004 polypeptides.

64. PRO1111

Protein-protein interactions include receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

All proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglubular shape. These two features have been indicated as responsible for the protein-binding functions of proteins containing leucine-rich repeats. See, Kobe and Deisenhofer, *Trends Biochem. Sci.*, 19(10):415–421 (October 1994).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome, Chlemetson, K. J., *Thromb. Haemost.* (Germany), 74(1):111–116 (July 1995), reporting that platelets have leucine rich repeats and Ruoslahti, E. I., et al., WO9110727-A by La Jolla Cancer Research Foundation reporting that decorin binding to transforming growth factorβ has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit of IGF (ALS) is also of interest in that it increases the half-life of IGF and is part of the IGF complex in vivo.

Another protein which has been reported to have leucine-rich repeats is the SLIT protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-A1 by Yale University. Of particular interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37):22522 (1996). Other studies reporting on the biological functions of proteins having leucine rich repeats include: Tayar, N., et al., *Mol. Cell Endocrinol.*, (Ireland), 125(1–2):65–70 (December 1996) (gonadotropin receptor involvement); Miura, Y., et al., *Nippon Rinsho* (Japan), 54(7):1784–1789 (July 1996) (apoptosis involvement); Harris, P. C., et al., *J. Am. Soc. Nephrol.*, 6(4):1125–1133 (October 1995) (kidney disease involvement).

We herein describe the identification and characterization of novel polypeptides having homology to LIG, designated herein as PRO1111 polypeptides.

65. PRO1344

Factor C is a protein that is intimately involved with the coagulation cascade in a variety of organisms. The coagulation cascade has been shown to involve numerous different intermediate proteins, including factor C, all of whose activity is essential to the proper functioning of this cascade. Abnormal coagulation cascade function can result in a variety of serious abnormalities and, as such, the activities of the coagulation cascade proteins is of particular interest. As such, efforts are currently being undertaken to identify novel polypeptides having homology to one or more of the coagulation cascade proteins.

We herein describe the identification and characterization of novel polypeptides having homology to factor C protein, designated herein as PRO1344 polypeptides.

66. PRO1109

Carbohydrate chains on glycoproteins are important not only for protein conformation, transport and stability, but also for cell-cell and cell-matrix interactions. β-1,4-galactosyltransferase is an enzyme that is involved in producing carbohydrate chains on proteins, wherein the β-1,4-galactosyltransferase enzyme acts to transfer galactose to the terminal N-acetylglucosamine of complex-type N-glycans in the Golgi apparatus (Asano et al., *EMBO J.* 16:1850–1857 (1997)). In addition, it has been suggested that β-1,4-galactosyltransferase is involved directly in cell-cell interactions during fertilization and early embryogenesis through a subpopulation of this enzyme distributed on the cell surface. Specifically, Lu et al., *Development* 124:4121–4131 (1997) and Larson et al., *Biol. Reprod.* 57:442–453 (1997) have demonstrated that β-1,4-galactosyltransferase is expressed on the surface of sperm from a variety of mammalian species, thereby suggesting an important role in fertilization. In light of the above, novel polypeptides having sequence identity to β-1,4-galactosyltransferase are of interest.

We herein describe the identification and characterization of novel polypeptides having homology to β-1,4-galactosyltransferase, designated herein as PRO1109 polypeptides.

67. PRO1383

The nmb gene is a novel gene that encodes a putative transmembrane glycoprotein which is differentially expressed in metastatic human melanoma cell lines and which shows substantial homology to the precursor of pMEL17, a melanocyte-specific protein (Weterman et al., *Int. J. Cancer* 60:73–81 (1995)). Given the interest in identifying tumor-specific cell-surface polypeptide markers, there is substantial interest in novel polypeptides having homology to nmb. We herein describe the identification and characterization of novel polypeptides having homology to the nmb protein, designated herein as PRO1383 polypeptides.

68. PRO1003

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1003 polypeptides.

69. PRO1108

Lysophosphatidic acid acyltransferase (LPAAT) is an enzyme that in lipid metabolism converts lysophosphatidic acid (LPA) into phosphatidic acid (PA). LPA is a phospholipid that acts as an intermediate in membrane phospholipid metabolism. Various LPAAT enzymes have been identified in a variety of species (see, e.g., Aguado et al., *J. Biol. Chem.* 273:4096–4105 (1998), Stamps et al., *Biochem. J.* 326:455–461 (1997), Eberhart et al., *J. Biol. Chem.* 272:20299–20305 (1997) and West et al., *DNA Cell Biol.* 16:691–701 (1997)). Given the obvious importance of LPAAT in a variety of different applications including cell membrane maintenance, there is substantial interest in identifying and characterizing novel polypeptides having homology to LPAAT. We herein describe the identification and characterization of novel polypeptides having homology to LPAAT protein, designated herein as PRO1108 polypeptides.

70. PRO1137

A particular class of secreted polypeptides that are of interest in research and industry are ribosyltransferases. Braren et al. described the use of EST databases for the identification and cloning of novel ribosyltransferase gene family members (*Adv. Exp. Med. Biol.* 419:163–168 (1997)). Ribosyltransferases have been identified playing roles in a variety of metabolic functions including posttranslational modification of proteins (Saxty et al., *J. Leukoc. Biol.*, 63(1):15–21 (1998)), and mediation of the assembly of filamentous actin and chemotaxis in polymorphonuclear neutrophil leukocytes (Kefalas et al. *Adv. Exp. Med. Biol.* 419:241–244 (1997)).

Described herein is the identification and characterization of novel polypeptides having homology to ribosyltransferase, designated herein as PRO1137 polypeptides.

71. PRO1138

Efforts are being undertaken by both industry and academia to identify new, native receptor proteins. Many efforts are focused on the screening of mammalian recombinant DNA libraries to identify the coding sequences for novel receptor proteins. Of particular interest is the identification of membrane-bound proteins found in cells of the hematopoietic system, as they often play important roles in fighting infection, repair of injured tissues, and other activities of cells of the hematopoietic system. For instance, CD84 leukocyte antigen has recently been identified as a new member of the Ig superfamily (de la Fuente et al., *Blood*, 90(6):2398–2405 (1997)).

Described herein is the identification and characterization of a novel polypeptide having homology to CD84 leukocyte antigen, designated herein as PRO1138 polypeptides.

72. PRO1054

The proteins of the major urinary protein complex (MUP), proteins which are members of the lipocalin family, function to bind to volatile pheromones and interact with the vomeronasal neuro epithelium of the olfactory system. As such, proteins in the MUP family are intimately involved in the process of attraction between mammals of different sexes. Many different MUP family members have been identified and characterized and shown to possess varying degrees of amino acid sequence homology (see, e.g., Mucignat et al., *Chem. Senses* 23:67–70 (1998), Ferrari et al., *FEBS Lett.* 401:73–77 (1997) and Bishop et al., *EMBO J.* 1:615–620 (1982)). Given the physiological and biological importance of the MUP family of proteins, there is significant interest in identifying and characterizing novel members of this family. We herein describe the identification and characterization of novel polypeptides having homology to MUP family of proteins, designated herein as PRO1054 polypeptides.

73. PRO994

The L6 cell surface antigen, which is highly expressed on lung, breast, colon, and ovarian carcinomas, has attracted attention as a potential therapeutic target for murine monoclonal antibodies and their humanized counterparts (Marken et al., *Proc. Natl. Acad. Sci. USA* 89:3503–3507 (1992)). The cDNA encoding this tumor-associated cell surface antigen has been expressed in COS cells and shown to encode a 202 amino acid polypeptide having three transmembrane domains. The L6 antigen has been shown to be related to a number of cell surface proteins that have been implicated in the regulation of cell growth, including for example CD63 and CO-029, proteins which are also highly expressed on tumor cells. As such, there is significant interest in identifying novel polypeptides having homology to the L6 tumor cell antigen as potential targets for cancer therapy. We herein describe the identification and characterization of novel polypeptides having homology to the L6 cell surface tumor cell-associated antigen, designated herein as PRO994 polypeptides.

74. PRO812

Steroid binding proteins play important roles in numerous physiological processes associated with steroid function. Specifically, one steroid binding protein-associated polypeptide that has been well characterized is component 1 of the prostatic binding protein. Component 1 of the prostatic binding protein has been shown to be specific for subunit F of the prostatic binding protein, the major secretory glycoprotein of the rat ventral prostate (Peeters et al., *Eur. J. Biochem.* 123:55–62 (1982) and Liao et al., *J. Biol. Chem.* 257:122–125 (1982)). The amino acid sequence of component 1 of the prostatic binding protein has been determined, wherein the sequence is highly rich in glutamic acid residues and is overall highly acidic. This protein plays an important role in the response of the prostate gland to steroid hormones. We herein describe the identification and characterization of novel polypeptides having homology to prostatic steroid-binding protein c1, designated herein as PRO812 polypeptides.

75. PRO1069

Of particular interest is the identification of new membrane-bound proteins involved in ion conductance such as channel inhibitory factor (CHIF) and MAT-8, which have recently been reported (see Wald et al., *Am. J. Physiol*, 272(5 pt 2): F617–F623 (1997); Capurro et al., *Am. J. Physiol*, 271(3 pt 1): C753–C762 (1996); Wald et al., *Am. J. Physiol*, 271(2 pt 2): F322–F329 (1996); and Morrison et al., *J. Biol. Chem* 270(5):2176–2182 (1995)).

Described herein is the identification and characterization of novel polypeptides having homology to CHIF and MAT-8 polypeptides, designated herein as PRO1069 polypeptides.

76. PRO1129

Cytochromes P-450 are a superfamily of hemoproteins which represent the main pathway for drug and chemical oxidation (Horsmans, *Acta Gastroenterol. Belg.* 60:2–10 (1997)). This superfamily is divided into families, subfamilies and/or single enzymes. Recent reports have provided a great deal of information concerning the cytochrome P-450 isozymes and increased awareness of life threatening interactions with such commonly prescribed drugs as cisapride and some antihistamines (Michalets, *Pharmacotherapy* 18:84–112 (1998) and Singer et al., *J. Am. Acad. Dermatol.* 37:765–771 (1997)). Given this information, there is significant interest in identifying novel members of the cytochrome P-450 family of proteins. We herein describe the identification and characterization of novel polypeptides having homology to cytochrome P-450 proteins, designated herein as PRO1129 polypeptides.

77. PRO1068

Urotensins are neurosecretory proteins that are of interest because of their potential roles in a variety of physiological processes including smooth muscle contraction (Yano et al. *Gen. Comp. Endocrinol.* 96(3): 412–413 (1994)), regulation of arterial blood pressure and heart rate (Le Mevel et al. *Am. J. Physiol.* 271(5 Pt 2): R1335–R1343 (1996)), and corticosteroid secretion (Feuilloley et al. *J. Steroid Biochem Mol. Biol.* 48(2–3): 287–292 (1994)).

We herein describe the identification and characterization of novel polypeptides having homology to urotensin, designated herein as PRO1068 polypeptides.

78. PRO1066

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1066 polypeptides.

79. PRO1184

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1184 polypeptides.

80. PRO1360

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1360 polypeptides.

81. PRO1029

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1029 polypeptides.

82. PRO1139

Obesity is the most common nutritional disorder which, according to recent epidemiologic studies, affects about one third of all Americans 20 years of age or older. Kuczmarski et al., *J. Am. Med. Assoc.* 272, 205–11 (1994). Obesity is responsible for a variety of serious health problems, including cardiovascular disorders, type II diabetes, insulin-resistance, hypertension, hypertriglyceridemia, dyslipoproteinemia, and some forms of cancer. Pi-Sunyer, F. X., *Anns. Int. Med.* 119, 655–60 (1993); Colfitz, G. A., *Am. J. Clin. Nutr.* 55, 503S–507S (1992). A single-gene mutation (the obesity or "ob" mutation) has been shown to result in obesity and type II diabetes in mice. Friedman, *Genomics* 11, 1054–1062 (1991). Zhang et al., *Nature* 372, 425–431 (1994) have recently reported the cloning and sequencing of the mouse ob gene and its human homologue, and suggested that the ob gene product may function as part of a signaling pathway from adipose tissue that acts to regulate the size of the body fat depot. Parabiosis experiments performed more than 20 years ago predicted that the genetically obese mouse containing two mutant copies of the ob gene (ob/ob mouse) does not produce a satiety factor which regulates its food intake, while the diabetic (db/db) mouse produces but does not respond to a satiety factor. Coleman and Hummal, *Am. J. Physiol.* 217, 1298–1304 (1969); Coleman, *Diabetol.* 9, 294–98 (1973). OB proteins are disclosed, for example, in U.S. Pat. Nos. 5,532,336; 5,552,522; 5,552,523; 5,552,514; 5,554,727. Recent reports by three independent research teams have demonstrated that daily injections of recombinant OB protein inhibit food intake and reduce body weight and fat in grossly obese ob/ob mice but not in db/db mice (Pelleymounter et al., *Science* 269, 540–43 [1995]; Halaas et al., *Science* 269, 543–46 [1995]; Campfield et al., *Science* 269, 546–49 [1995]), suggesting that the ob protein is such a satiety factor as proposed in early cross-circulation studies.

A receptor of the OB protein (OB-R) is disclosed in Tartaglia et al., *Cell* 83, 1263–71 (1995). The OB-R is a single membrane-spanning receptor homologous to members of the class I cytokine receptor family (Tartaglia et al., supra; Bazan, *Proc. Natl. Acad. Sci. USA* 87, 6934–6938 [1990]). Two 5'-untranslated regions and several 3'-alternative splice variants encoding OB-R with cytoplasmic domains of different lengths have been described in mouse, rat and human (Chen et al., *Cell* 84, 491–495 [1996]; Chua et al., *Science* 271, 994–996 [1996]; Tartaglia et al., supra; Wang et al., *FEBS Lett*. 392:87–90 [1996]; Phillips et al., *Nature Genet.* 13, 18–19 [1996]; Cioffi et al., *Nature Med.*, 2 585–589 [1996]). A human hematopoetin receptor, which might be a receptor of the CB protein, is described in PCT application Publication No. WO 96/08510, published Mar. 21, 1996.

Bailleul et al., *Nucl. Acids Res.* 25, 2752–2758 (1997) identified a human mRNA splice variant of the OB-R gene that potentially encodes a novel protein, designated as leptin receptor gene-related protein (OB-RGRP). This protein displays no sequence similarity to the leptin receptor itself. The authors found that the OB-RGRP gene shares its promoter and two exons with the OB-R gene, and suggested that there is a requirement for a coordinate expression of OB-R and OB-RGRP to elicit the full physiological response to leptin in vivo.

83. PRO1309

Protein-protein interactions include receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

All proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglubular shape. These two features have been indicated as responsible for the protein-binding functions of proteins containing leucine-rich repeats. See, Kobe and Deisenhofer, *Trends Biochem. Sci.*, 19(10):415–421 (October 1994); Kobe and Deisenhofer, *Curr. Opin. Struct. Biol.*, 5(3):409–416 (1995).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome, Chlemetson, K. J., *Thromb. Haemost.* (Germany), 74(1):111–116 (July 1995), reporting that platelets have leucine rich repeats and Ruoslahti, E. I., et al., WO9110727-A by La Jolla Cancer Research Foundation reporting that decorin binding to transforming growth factors has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit of IGF (ALS) is also of interest in that it increases the half-life of IGF and is part of the IGF complex in vivo.

Another protein which has been reported to have leucine-rich repeats is the SLIT protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-Al by Yale University. Of particular interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37):22522 (1996). Other studies reporting on the biological functions of proteins having leucine rich repeats include: Tayar, N., et al., *Mol. Cell Endocrinol.*, (Ireland), 125(1–2):65–70 (December 1996) (gonadotropin receptor involvement); Miura, Y., et al., *Nippon Rinsho* (Japan), 54(7):1784–1789 (July 1996) (apoptosis involvement); Harris, P. C., et al., *J. Am. Soc. Nephrol.*, 6(4):1125–1133 (October 1995) (kidney disease involvement).

Efforts are therefore being undertaken by both industry and academia to identify new proteins having leucine rich repeats to better understand protein-protein interactions. Of particular interest are those proteins having leucine rich repeats and homology to known proteins having leucine rich repeats such as platelet glycoprotein V, SLIT and ALS. Many efforts are focused on the screening of mammalian recombinant DNA libraries to identify the coding sequences for novel membrane-bound proteins having leucine rich repeats.

84. PRO1028

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1028 polypeptides.

85. PRO1027

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1027 polypeptides.

86. PRO1107

Of particular interest are novel proteins having some sequence identity to known proteins. Known proteins include PC-1, an ecto-enzyme possessing alkaline phosphodiesterase I and nucleotide pyrophosphatase activities, further described in Belli et al., *Eur. J. Biochem.*, 228(3):669–676 (1995). Phosphodiesterases are also described in Fuss et al., *J. Neurosci.*, 17(23):9095–9103 (1997) and Scott et al., *Hematology*, 25(4):995–1002 (1997). Phosphodiesterase I, is described as a novel adhesin molecule and/or cytokine (related to autotaxin) involved in oligodendrocyte function. Fuss, supra.

We herein describe the identification and characterization of novel polypeptides having homology into PC-1, designated herein as PRO1107 polypeptides.

87. PRO1140

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1140 polypeptides.

88. PRO1106

As the mitochondria is primarily responsible for generating energy, proteins associated with the mitochondria are of interest. Recently, a cDNA from a novel $Ca^{++}$-dependent member of the mitochondrial solute carrier superfamily was isolated from a rabbit small intestinal cDNA library as described in Weber, et al., *PNAS USA*, 94(16):8509–8514 (1997). It was reported that this transporter has four elongation factor-hand motifs in the N-terminal and is localized in the peroxisome, although a fraction can be found in the mitochondria. Thus, this transporter, and proteins which have sequence identity to this and other members of the mitochondrial solute carrier superfamily are of particular interest.

We herein describe the identification and characterization of novel polypeptides having homology to a peroxisomal calcium dependent solute carrier protein, designated herein as PRO1106 polypeptides.

89. PRO1291

Butyrophilin is a milk glycoprotein that constitutes more than 40% of the total protein associated with the fat globule membrane in mammalian milk. Expression of butyrophilin mRNA has been shown to correlate with the onset of milk fat production toward the end pregnancy and is maintained throughout lactation. Butyrophilin has been identified in bovine, murine and human (see Taylor et al., *Biochim. Biophys. Acta* 1306:1–4 (1996), Ishii et al., *Biochim. Biophys. Acta* 1245:285–292 (1995), Mather et al., *J. Dairy Sci.* 76:3832–3850 (1993) and Banghart et al., *J. Biol. Chem.* 273:4171–4179 (1998)) and is a type I transmembrane protein that is incorporated into the fat globulin membrane. It has been suggested that butyrophilin may play a role as the principle scaffold for the assembly of a complex with xanthine dehydrogenase/oxidase and other proteins that function in the budding and release of milk-fat globules from the apical surface during lactation (Banghart et al., supra).

Given that butyrophilin plays an obviously important role in mammalian milk production, there is substantial interest in identifying novel butyrophilin homologs. We herein describe the identification and characterization of novel polypeptides having homology to butyrophilin, designated herein as PRO1291 polypeptides.

90. PRO1105

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1105 polypeptides.

91. PRO511

Proteins of interest include those having sequence identity with RoBo-1, a novel member of the urokinase plasminogen activator receptor/CD59/Ly-6/snake toxin family selectively expressed in bone and growth plate cartilage as described in Noel et al., *J. Biol. Chem.* 273(7):3878–3883 (1998). RoBo-1 is believed to play a novel role in the growth or remodeling of bone. Proteins also of interest include those having sequence identity with phospholipase inhibitors.

We herein describe the identification and characterization of novel polypeptides having homology to urokinase plasminogen activator receptors and phospholipase inhibitors, designated herein as PRO511 polypeptides.

92. PRO1104

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1104 polypeptides.

93. PRO1100

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1100 polypeptides.

94. PRO836

Of interest are luminal proteins, or proteins specific to the endoplasmic reticulum (ER). Of particular interest are proteins having sequence identity with known proteins. Known proteins include proteins such as SLS1. In *Saccharomyces cerevisiae*, SLS1 has been reported to be a mitochondrial integral membrane protein involved in mitochondrial metabolism. Rouillard, et al., *Mol. Gen. Genet.*, 252(6):700–708 (1996). In yeast *Yarrowia lipolytica*, it has been reported that the SLS1 gene product (SLS1p) behaves as a lumenal protein of the ER. It is believed that SPS1p acts in the preprotein translocation process, interacting directly with translocating polypeptides to facilitate their transfer and/or help their folding in the ER. Bosirame, et al., *J. Biol. Chem.*, 271(20):11668–11675 (1996).

We herein describe the identification and characterization of novel polypeptides having homology to SLS1, designated herein as PRO836 polypeptides.

95. PRO1141

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1141 polypeptides.

96. PRO1132

Proteases are enzymatic proteins which are involved in a large number of very important biological processes in mammalian and non-mammalian organisms. Numerous different protease enzymes from a variety of different mammalian and non-mammalian organisms have been both identified and characterized, including the serine proteases which exhibit specific activity toward various serine-containing proteins. The mammalian protease enzymes play important roles in biological processes such as, for example, protein digestion, activation, inactivation, or modulation of peptide hormone activity, and alteration of the physical properties of proteins and enzymes.

Neuropsin is a novel serine protease whose mRNA is expressed in the central nervous system. Mouse neuropsin has been cloned, and studies have shown that it is involved in the hippocampal plasticity. Neuropsin has also been indicated as associated with extracellular matrix modifications and cell migrations. See, generally, Chen, et al., *Neurosci.*, 7(2):5088–5097 (1995) and Chen, et al., *J. Histochem. Cytochem.*, 46:313–320 (1998).

Another serine protease of interest is the enamel matrix serine proteinase. The maturation of dental enamel succeeds the degradation of organic matrix. Inhibition studies have shown that this degradation is accomplished by a serine-type proteinase. Proteases associated with enamel maturation are described in, i.e., Simmer, et al., *J. Dent. Res.*, 77(2):377–386 (1998), Overall and Limeback, *Biochem J.*, 256(3):965–972 (1988), and Moradian-Oldak, *Connect. Tissue Res.*, 35(14):231–238 (1996).

We herein describe the identification and characterization of novel polypeptides having homology to serine proteases, designated herein as PRO1132 polypeptides.

97. PRO1346

The abbreviations "TIE" or "tie" are acronyms, which stand for "tyrosine kinase containing Ig and EGF homology domains" and were coined to designate a new family of receptor tyrosine kinases which are almost exclusively expressed in vascular endothelial cells and early hemopoietic cells, and are characterized by the presence of an EGF-like domain, and extracellular folding units stabilized by intra-chain disulfide bonds, generally referred to as "immunoglobulin (IG)-like" folds. A tyrosine kinase homologous cDNA fragment from human leukemia cells (tie) was described by Partanen et al., *Proc. Natl. Acad. Sci. USA* 87, 8913–8917 (1990). The mRNA of this human "TIE" receptor has been detected in all human fetal and mouse embryonic tissues, and has been reported to be localized in the cardiac and vascular endothelial cells. Korhonen et al., *Blood* 80, 2548–2555 (1992); PCT Application Publication No. WO 93/14124 (published Jul. 22, 1993). The rat homolog of human TIE, referred to as "TIE-1", was identified by Maisonpierre et al., *Oncozene* 8, 1631–1637 (1993)). Another TIE receptor, designated "TIE-2" was originally identified in rats (Dumont et al., *Oncogene* 8, 1293–1301 (1993)), while the human homolog of TIE2, referred to as "ork" was described in U.S. Pat. No. 5,447,860 (Ziegler). The murine homolog of TIE-2 was originally termed "tek." The cloning of a mouse TIE-2 receptor from a brain capillary cDNA library is disclosed in PCT Application Publication No. WO 95/13387 (published May 18, 1995). TIE-2 is a receptor tyrosine kinase that is expressed almost exclusively by vascular endothelium. Tie-2 knockout mice die by defects in the formation of microvassels. Accordingly, the TIE receptors are believed to be actively involved in angiogenesis, and may play a role in hemopoiesis as well. Indeed, recent results (Lin et al., *J. Clin. Invest.* 100(8), 2072–2078 [1997]) demonstrating the ability of a soluble TIE-2 receptor to inhibit tumor angiogenesis have been interpreted to indicate that TIE-2 plays a role in pathologic vascular growth. In another study, TIE-2 expression was examined in adult tissues undergoing angiogenesis and in quiescent tissues. TIE2 expression was localized by immunohistochemistry to the endothelium of neovessels in rat tissues undergoing angiogenesis during hormonally stimulated follicular maturation and uterine development and in healing wounds. TIE-2 was also reported to be expressed in the entire spectrum of the quiescent vasculature (arteries, veins, and capillaries) in a wide range of adult tissues. Wong et al., *Circ. Res.* 81(4), 567–574 (1997). It has been suggested that TIE-2 has a dual function in adult angiogenesis and vascular maintenance.

The expression cloning of human TIE-2 ligands has been described in PCT Application Publication No. WO 96/11269 (published Apr. 18, 1996) and in U.S. Pat. No. 5,521,073 (published May 28, 1996). A vector designated as λgt10 encoding a TIE-2 ligand NL7d "htie-2 ligand 1" or "hTL1" has been deposited under ATCC Accession No. 75928. A plasmid encoding another TIE-2 ligand designated "htie-22" or "hTL2" is available under ATCC Accession No. 75928. This second ligand has been described as an antagonist of the TAI-2 receptor. The identification of secreted human and mouse ligands for the TIE-2 receptor has been reported by Davis et al., *Cell* 87, 1161–1169 (1996). The human ligand designated "Angiopoietin-1", to reflect its role in angiogenesis and potential action during hemopoiesis, is the same ligand as the ligand variously designated as "htie-21" or "hTL-1" in WO 96/11269. Angiopoietin-1 has been described to play an angiogenic role later and distinct from that of VEGF (Suri et al., *Cell* 87, 1171–1180 (1996)). Since TIE-2 is apparently upregulated during the pathologic angiogenesis requisite for tumor growth (Kaipainen et al., *Cancer Res.* 54, 6571–6577 (1994)) angiopoietin-1 has been suggested to be additionally useful for specifically targeting tumor vasculature (Davis et al., supra).

We herein describe the identification and characterization of novel TIE ligand polypeptides, designated herein as PRO1346 polypeptides.

98. PRO1131

The low density lipoprotein (LDL) receptor is a membrane-bound protein that plays a key role in cholesterol homeostasis, mediating cellular uptake of lipoprotein particles by high affinity binding to its ligands, apolipoprotein (apo) B-100 and apoE. The ligand-binding domain of the LDL receptor contains 7 cysteine-rich repeats of approximately 40 amino acids, wherein each repeat contains 6 cysteines, which form 3 intra-repeat disulfide bonds. These unique structural features provide the LDL receptor with its ability to specifically interact with apo B-100 and apoE, thereby allowing for transport of these lipoprotein particles across cellular membranes and metabolism of their components. Soluble fragments containing the extracellular domain of the LDL receptor have been shown to retain the ability to interact with its specific lipoprotein ligands (Simmons et al., *J. Biol. Chem.* 272:25531–25536 (1997)). LDL receptors are further described in Javitt, *FASEB J.*, 9(13):1378–1381 (1995), van Berkel, et al., *Atherosclerosis*, 118 Suppl:S43–S50 (1995) and Herz and Willnow, *Ann. NY Acad. Sci.*, 737:14–19 (1994). Thus, proteins having sequence identity with LDL receptors are of interest.

We herein describe the identification and characterization of novel polypeptides having homology to LDL receptors, designated herein as PRO1131 polypeptides.

99. PRO1281

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1281 polypeptides.

100. PRO1064

Efforts are being undertaken by both industry and academia to identify new, native membrane-bound proteins. Many of these efforts are focused on the screening of mammalian recombinant DNA libraries to identify the coding sequences for novel membrane-bound proteins. We herein describe the identification and characterization of novel transmembrane polypeptides, designated herein as PRO1064 polypeptides.

101. PRO1379

Efforts are being undertaken by both industry and academia to identify new, native secreted proteins. Many of these efforts are focused on the screening-of mammalian recombinant DNA libraries to identify the coding sequences for novel secreted proteins. We herein describe the identification and characterization of novel secreted polypeptides, designated herein as PRO1379 polypeptides.

102. PRO844

Proteases are enzymatic proteins which are involved in a large number of very important biological processes in mammalian and non-mammalian organisms. Numerous different protease enzymes from a variety of different mammalian and non-mammalian organisms have been both identified and characterized. The mammalian protease enzymes play important roles in many different biological processes including, for example, protein digestion, activation, inactivation, or modulation of peptide hormone activity, and alteration of the physical properties of proteins and enzymes. Thus, proteases are of interest. Also of interest are protease inhibitors.

Of particular interest are serine proteases. In one study it was reported that when the serine protease inhibitor anti-leukoproteinase (aLP) is injected, it accumulates in articular and extraarticular cartilage of normal rats. This physiological pathway of cartilage accumulation, lost in proteoglycan depleted arthritic cartilage is believed to serve to maintain the local balance between proteinase function and inhibition. Burkhardt, et al., *J. Rheumatol*, 24(6):1145–1154 (1997). Moreover, aLP and other protease inhibitors have been reported to play a role in the in vitro growth of hematopoietc cells by the neutralization of proteinases produced by bone marrow accessory cells. Gosklink, et al., *J. Exp. Med.*, 184(4):1305–1312 (1996). Also of interest are mutants of aLP. Oxidation resistant mutants of aLPe have been reported to have significant therapeutic effects on animal models having emphysema. Steffens, et al., *Agents Actions Suppl.*, 42:111–121 (1993). Thus, serine protease inhibitors are of interest.

We herein describe the identification and characterization of novel polypeptides having homology to serine protease inhibitors, designated herein as PRO844 polypeptides.

103. PRO848

Membrane-bound proteins of interest include channels such as ion channels. Furthermore, membrane-bound proteins of interest include enzymes bound to intracellular vacuoles or organelles, such as transferases. For example, a peptide of interest is the GalNAc alpha 2,6-sailytransferase as described in Kurosawa, et al., *J. Biol. Chem.*, 269(2):1402–1409 (1994). This peptide was constructed to be secreted, and retained its catalytic activity. The expressed enzyme exhibited activity toward asialomucin and asialofetuin, but not other glycoproteins tested. As sialylation is an important function, sialyltransferases such as this one, and peptides related by sequence identity, are of interest.

We herein describe the identification and characterization of novel polypeptides having homology to sialyltransferases, designated herein as PRO848 polypeptides.

104. PRO1097

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1097 polypeptides.

105. PRO1153

Efforts are being undertaken by both industry and academia to identify new, native membrane-bound proteins. Many of these efforts are focused on the screening of mammalian recombinant DNA libraries to identify the coding sequences for novel transmembrane proteins. We herein describe the identification and characterization of novel transmembrane polypeptides, designated herein as PRO1153 polypeptides.

106. PRO1154

Aminopeptidase N causes enzymatic degradation of perorally administered peptide drugs. Thus, aminopeptidase N has been used in studies to develop and identify inhibitors so as to increase the efficacy of peptide drugs by inhibiting their degradation. Aminopeptidases are also generally of interest to use to degrade peptides. Aminopeptidases, particularly novel aminopeptidases are therefore of interest. Aminopeptidase N and inhibitors thereof are further described in Bernkop-Schnurch and Marschutz, *Pharm. Res.*, 14(2):181–185 ((1997); Lerche, et al., *Mamm. Genome*, 7(9):712–713 (1996); Papapetropoulos, et al., *Immunopharmacology*, 32(1–3):153–156 (1996); Miyachi, et al., *J. Med. Chem.*, 41(3):263–265 (1998); and Olsen, et al., *Adv. Exp. Med. Biol.*, 421:47–57 (1997).

We herein describe the identification and characterization of novel polypeptides having homology to aminopeptidase N, designated herein as PRO1154 polypeptides.

107. PRO1181

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1181 polypeptides.

108. PRO1182

Conglutinin is a bovine serum protein that was originally described as a vertebrate lectin protein and which belongs to the family of C-type lectins that have four characteristic domains, (1) an N-terminal cysteine-rich domain, (2) a collagen-like domain, (3) a neck domain and (4) a carbohydrate recognition domain (CRD). Recent reports have demonstrated that bovine conglutinin can inhibit hemagglutination by influenza A viruses as a result of their lectin properties (Eda et al., *Biochem. J.* 316:43–48 (1996)). It has also been suggested that lectins such as conglutinin can function as immunoglobulin-independent defense molecules due to complement-mediated mechanisms. Thus, conglutinin has been shown to be useful for purifying immune complexes in vitro and for removing circulating immune complexes from patients plasma in vivo (Lim et al., *Biochem. Biophys. Res. Commun.* 218:260–266 (1996)). We herein describe the identification and characterization of novel polypeptides having homology to conglutinin protein, designated herein as PRO1182 polypeptides.

109. PRO1155

Substance P and the related proteins, neurokinin A and neurokinin B have been reported as compounds which elicit contraction of the ileum both directly through action on a muscle cell receptor and indirectly through stimulation of a neuronal receptor. This action leads to the release of acetylcholine which causes muscle contraction via muscarinic receptors. It has also been reported that neurolinin B was found to be the most potent agonist for the neuronal Substance P receptor and that neurokinin B can be inhibited by enkephalinamide. Laufer, et al., *PNAS USA*, 82(21):74444–7448 (1985). Moreover, neurokinin B has been reported to provide neuroprotection and cognitive enhancement, and therefore believed to be useful for the treatment of neurodegenerative disorders, including alzheimers disease. Wenk, et al., *Behav. Brain Res.*, 83(1–2):129–133 (1997). Tachykinins are also described in Chawla, et al., *J. Comp. Neurol.*, 384(3):429–442 (1997). Thus, tachykinins, particularly those related to neurokinin B are of interest.

We herein describe the identification and characterization of novel polypeptides having homology to neurokinin B protein, designated herein as PRO1155 polypeptides.

110. PRO1156

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1181 polypeptides.

111. PRO1098

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1098 polypeptides.

112. PRO1127

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1127 polypeptides.

113. PRO1126

The extracellular mucous matrix of olfactory neuroepithelium is a highly organized structure in intimate contact with chemosensory cilia that house the olfactory transduction machinery. The major protein component of this extracellular matrix is olfactomedin, a glycoprotein that is expressed in olfactory neuroepithelium and which form intermolecular disulfide bonds so as to produce a polymer (Yokoe et al., *Proc. Natl. Acad. Sci. USA* 90:4655–4659 (1993), Bal et al., *Biochemistry* 32:1047–1053 (1993) and Snyder et al., *Biochemistry* 30:9143–9153 (1991)). It has been suggested that olfactomedin may influence the maintenance, growth or differentiation of chemosensory cilia on the apical dendrites of olfactory neurons. Given this important role, there is significant interest in identifying and characterizing novel polypeptides having homology to olfactomedin. We herein describe the identification and characterization of novel polypeptides having homology to olfactomedin protein, designated herein as PRO1126 polypeptides.

114. PRO1125

Of particular interest are proteins which have multiple Trp-Asp (WD) repeats. WD proteins are made up of highly conserved repeating units usually ending with WD. They are found in eukaryotes but not in prokaryotes. They regulate cellular functions, such as cell division, cell-fate determination, gene transcription, gene transcription, transmembrane signaling, mRNA modification and vesicle fusion. WD are further described in Neer, et al., *Nature*, 371(6495):297–300 (1994); Jiang and Struhl, *Nature*, 391(6666):493–496(1998); and DeSilva, et al., *Genetics*, 148(2):657–667 (1998). Thus, new members of this superfamily are all of interest.

115. PRO1186

Protein A from *Dendroaspis polylepis polylepis* (black mamba) venom comprises 81 amino acids, including ten half-cystine residues. Venoms are of interest on the one hand as weapons in war, and on the other hand, to use in assays to determine agents which reverse or inhibit the effects of the venom or a similar poison. Black mamba venom is further described in *Int. J. Biochem.*, 17(6):695–699 (1985) and Joubert and Strydom, *Hoppe Seylers Z Physiol. Chem.*, 361(12):1787–1794 (1980).

We herein describe the identification and characterization of novel polypeptides having homology to snake venom protein A, designated herein as PRO1186 polypeptides.

116. PRO1198

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1198 polypeptides.

117. PRO1158

Efforts are being undertaken by both industry and academia to identify new, native membrane-bound proteins. Many of these efforts are focused on the screening of mammalian recombinant DNA libraries to identify the coding sequences for novel transmembrane proteins. We herein describe the identification and characterization of novel transmembrane polypeptides, designated herein as PRO1158 polypeptides.

118. PRO1159

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1159 polypeptides.

119. PRO1124

Ion channels are considered to be the gateway to the final frontier, the brain. Ion channels and the receptors which control these channels are responsible for the passage of ions, or nerve impulses to be communicated from cell to cell, thus, ion channels are responsible for communication. In addition to their critical role in the brain, ion channels play a critical role in the heart as well as blood pressure. Ion channels have also been linked to other important bodily functions and conditions, as well as disorders, such as cystic fibrosis. For all of these reasons, ion channels, such as sodium, potassium and chloride channels, as well as all of their related proteins and receptors are of interest. For example, it has been reported that cystic fibrosis results from a defect in the chloride channel protein, cystic fibrosis transmembrane conductance regulator. McGill, et al., *Dig. Dis. Sci.*, 41(3):540–542 (1996). Chloride channels are further described in at least Finn, et al., *PNAS USA*, 90(12):5691–569 (1993) and Finn, et al., *Mol. Cell Biochem.*, 114(1–2):21–26 (1992).

Also of interest are molecules related to adhesion molecules, as adhesion molecules are known to be involved in cell-cell signaling and interactions. More generally, all novel membrane bound-proteins are of interest. Membrane-bound proteins and receptors can play an important role in the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, channels, transporters, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins include those which are bound to the outer membrane and intracellular membranes and organelles. Membrane-bound proteins and receptor molecules have various industrial applications, including as pharmaceutical and diagnostic agents. Receptor immunoadhesins, for instance, can be employed as therapeutic agents to block receptor-ligand interaction. The membrane-bound proteins can also be employed for screening of potential peptide or small molecule inhibitors of the relevant receptor/ligand interaction.

Efforts are being undertaken by both industry and academia to identify new, native receptor proteins. Many efforts are focused on the screening of mammalian recombinant DNA libraries to identify the coding sequences for novel receptor proteins. Herein is presented a polypeptide and nucleic acid encoding therefor which has sequence identity with a chloride channel protein chloride channel protein and lung-endothelial cell adhesion molecule-1 (ECAM-1).

120. PRO1287

Fringe is a protein which specifically blocks serrate-mediated activation of notch in the dorsal compartment of the *Drosophila* wing imaginal disc. Fleming et al., *Development*, 124(15):2973–81 (1997). Therefore, fringe protein is of interest for both its role in development as well as its ability to regulate serrate, particularly serrate's signaling abilities. Also of interest are novel polypeptides which may have a role in development and/or the regulation of serrate-like molecules. Of particular interest are novel polypeptides having homology to fringe.

We herein describe the identification and characterization of novel polypeptides having homology to fringe protein, designated herein as PRO1287 polypeptides.

121. PRO1312

Efforts are being undertaken by both industry and academia to identify new, native membrane-bound proteins. Many of these efforts are focused on the screening of mammalian recombinant DNA libraries to identify the coding sequences for novel transmembrane proteins. We herein describe the identification and characterization of novel transmembrane polypeptides, designated herein as PRO1312 polypeptides.

122. PRO1192

Membrane-bound proteins of myelin are of interest because of their possible implications in various nervous system disorders associated with improper myelination. Myelin is a cellular sheath, formed by glial cells, that surrounds axons and axonal processes that enhances various electrochemical properties and provides trophic support to the neuron. Myelin is formed by Schwann cells in the peripheral nervous system (PNS) and by oligodendrocytes in the central nervous system (CNS). Improper myelination of central and peripheral neurons occurs in a number of pathologies and leads to improper signal conduction within the nervous systems. Among the various demyelinating diseases Multiple Sclerosis is the most notable.

The predominant integral membrane protein of the CNS myelin of amphibians, reptiles, birds and mammals are proteolipid protein (PLP) and P0, the main glycoprotein in PNS myelin. (Schlieess and Stoffel, *Biol. Chem. Hoppe Seyler* (1991) 372(9):865–874). In view of the importance of membrane-bound proteins of the myelin, efforts are being undertaken by both industry and academia to identify and characterize various myelin proteins (see Stratmann and Jeserich, *J. Neurochem* (1995) 64(6):2427–2436).

123. PRO1160

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1160 polypeptides.

124. PRO1187

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1187 polypeptides.

125. PRO1185

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1185 polypeptides.

126. PRO345

Human tetranectin is a 202 amino acid protein encoded by a gene spanning approximately 12 kbp of DNA (Berglund et al., *FEBS Lett*. 309:15–19 (1992)). Tetranectin has been shown to be expressed in a variety of tissues and functions primarily as a plasminogen binding protein. Tetranectin has been classified in a distinct group of the C-type lectin superfamily but has structural and possibly functional similarity to the collectin proteins (Nielsen et al., *FEBS Lett*. 412(2):388–396 (1997)). Recent studies have reported that variability in serum tetranectin levels may be predictive of the presence of various types of cancers including, for example, ovarian and colorectal cancers (Hogdall et al.,*Acta Oncol*. 35:63–69 (1996), Hogdall et al., *Eur. J. Cancer* 31A(6):888–894 (1995) and Tuxen et al., *Cancer Treat. Rev*. 21(3):215–245 (1995)). As such, there is significant interest in identifying and characterizing novel polypeptides having structural and functional similarity to the tetranectin protein.

We herein describe the identification and characterization of novel polypeptides having homology to tetranectin protein, designated herein as PRO1345 polypeptides.

127. PRO1245

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1245 polypeptides.

128. PRO358

Serine protease inhibitors are of interest because they inhibit catabolism and are sometimes associated with regeneration of tissue. For example, a gene encoding a plasma protein associated with liver regeneration has been cloned and termed regeneration-associated serpin-1 (RASP-1). New, et al., *Biochem. Biophys. Res. Commun.*, 223(2):404412 (1996). While serine protease inhibitors are of interest, particularly of interest are those which have sequence identity with known serine protease inhibitors such as RASP-1.

We herein describe the identification and characterization of novel polypeptides having homology to RASP-1, designated herein as PRO1245 polypeptides.

129. PRO1195

Efforts are being undertaken by both industry and academia to identify new, native secreted proteins. Many of these efforts are focused on the screening of mammalian recombinant DNA libraries to identify the coding sequences for novel secreted proteins. We herein describe the identification and characterization of novel secreted polypeptides, designated herein as PRO1195 polypeptides.

130. PRO1270

The recognition of carbohydrates by lectins has been found to play an important role in various aspects of eukaryotic physiology. A number of different animal and plant lectin families exist, but it is the calcium dependent, or type C, lectins that have recently garnered the most attention. For example, the recognition of carbohydrate residues on either endothelial cells or leukocytes by the selectin family of calcium dependent lectins has been found to be of profound importance to the trafficking of leukocytes to inflammatory sites. Lasky, L., Ann. Rev. Biochem., 64 113–139 (1995). The biophysical analysis of these adhesive interactions has suggested that lectin-carbohydrate binding evolved in this case to allow for the adhesion between leukocytes and the endothelium under the high shear conditions of the vasculature. Thus, the rapid on rates of carbohydrate recognition by such lectins allows for a hasty acquisition of ligand, a necessity under the high shear of the vascular flow. The physiological use of type C lectins in this case is also supported by the relatively low affinities of these interactions, a requirement for the leukocyte rolling phenomenon that has been observed to occur at sites of acute inflammation. The crystal structures of the mannose binding protein (Weis et al., Science 254, 1608–1615 [1991]; Weis et al., Nature 360 127–134 [1992]) and E-selectin (Graves et al., Nature 367(6463), 532–538 [1994]), together with various mutagenesis analyses (Erbe et al., J. Cell. Biol. 119(1), 215–227 [1992]; Drickamer, Nature 360, 183–186 [1992]; Iobstet al., J. Biol. Chem. 169(22), 15505–15511 [1994]; Kogan et al., J. Biol. Chem. 270(23), 14047–14055 [1995]), is consistent with the supposition that the type C lectins are, in general, involved with the rapid recognition of clustered carbohydrates. Together, these data suggest that type C lectins perform a number of critical physiological phenomena through the rapid, relatively low affinity recognition of carbohydrates.

Given the obvious importance of the lectin proteins in numerous biological processes, efforts are currently being made to identify novel lectin proteins or proteins having sequence homology to lectin proteins. We herein describe the identification and characterization of novel polypeptides having homology to a lectin protein, designated herein as PRO1270 polypeptides.

131. PRO1271

Efforts are being undertaken by both industry and academia to identify new, native membrane-bound proteins. Many of these efforts are focused on the screening of mammalian recombinant DNA libraries to identify the coding sequences for novel transmembrane proteins. We herein describe the identification and characterization of novel transmembrane polypeptides, designated herein as PRO1271 polypeptides.

132. PRO1375

The proteins L1CAM, G6PD and P55 are each associated with various known disease states. Thus, the genomic loci of Fugu rubripes homologs of the human disease genes LICAM, G6PD and P55 were analyzed. This analysis led to the the identification of putative protein 2 (PUT2), GENBANK locus AF026198, accession AF026198. (See GENBANK submission data). Thus, PUT2 and proteins which have sequence identity with PUT2, are of interest.

133. PRO1385

Efforts are being undertaken by both industry and academia to identify new, native secreted proteins.

Many of these efforts are focused on the screening of mammalian recombinant DNA libraries to identify the coding sequences for novel secreted proteins. We herein describe the identification and characterization of novel secreted polypeptides, designated herein as PRO1385 polypeptides.

134. PRO1387

Membrane-bound proteins of myelin are of interest because of their possible implications in various nervous system disorders associated with improper myelination. Myelin is a cellular sheath, formed by glial cells, that surrounds axons and axonal processes that enhances various electrochemical properties and provides trophic support to the neuron. Myelin is formed by Schwann cells in the peripheral nervous system (PNS) and by oligodendrocytes in the central nervous system (CNS). Improper myelination of central and peripheral neurons occurs in a number of pathologies and leads to improper signal conduction within the nervous systems. Among the various demyelinating diseases Multiple Sclerosis is the most notable.

The predominant integral membrane protein of the CNS myelin of amphibians, reptiles, birds and mammals are proteolipid protein (PLP) and P0, the main glycoprotein in PNS myelin. (Schlieess and Stoffel, Biol. Chem. Hoppe Seyler (1991) 372(9):865–874). In view of the importance of membrane-bound proteins of the myelin, efforts are being undertaken by both industry and academia to identify and characterize various myelin proteins (see Stratmann and Jeserich, J. Neurochem (1995) 64(6):2427–2436).

We herein describe the identification and characterization of novel polypeptides having homology to myelin protein, designated herein as PRO1387 polypeptides.

135. PRO1384

One class of receptor proteins that has been of interest is the NKG2 family of type II transmembrane molecules that are expressed in natural killer cells. These proteins, which have been shown to be covalently associated with CD94, are involved in natural killer cell-mediated recognition of different HLA-allotypes (Plougastel, B. et al., Eur. J. Immunol. (1997)27(11):2835–2839), and interact with major histocompatibility complex (MHC) class I to either inhibit or activate functional activity (Ho, EL. et al., Proc. Natl. Acad. Sci. (1998) 95(11):6320–6325). Accordingly, the identification and characterization of new members of this family of receptor proteins is of interest (see Houchins J P, et al. J. Exp. Med. (1991) 173(4):1017–1020).

SUMMARY OF THE INVENTION

1. PRO281

A cDNA clone (DNA16422-1209) has been identified, having homology to nucleic acid encoding testis enhanced gene transcript (TEGT) protein that encodes a novel polypeptide, designated in the present application as "PRO281".

In one embodiment, the invention provides an isolated nucleic acid molecule comprising DNA encoding a PRO281 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO281 polypeptide having the sequence of amino acid residues from about 1 or about 15 to about 345, inclusive of FIG. 2 (SEQ ID NO:2), or (b) the complement of the DNA molecule of (a).

In another aspect, the invention concerns an isolated nucleic acid molecule encoding a PRO281 polypeptide comprising DNA hybridizing to the complement of the nucleic acid between about nucleotides 80 or about 122 and about 1114, inclusive, of FIG. 1 (SEQ ID NO:1). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209929 (DNA16422-1209) or (b) the complement of the nucleic acid molecule of (a). In a preferred embodiment, the nucleic acid comprises a DNA encoding the same mature polypeptide encoded by the human protein cDNA in ATCC Deposit No. 209929 (DNA16422-1209).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 15 to about 345, inclusive of FIG. 2 (SEQ ID NO:2), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO281 polypeptide having the sequence of amino acid residues from 1 or about 15 to about 345, inclusive of FIG. 2 (SEQ ID NO:2), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO281 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 14 in the sequence of FIG. 2 (SEQ ID NO:2). The multiple transmembrane domains have been tentatively identified as extending from about amino acid position 83 to about amino acid position 105, from about amino acid position 126 to about amino acid position 146, from about amino acid position 158 to about amino acid position 177, from about amino acid position 197 to about amino acid position 216, from about amino acid position 218 to about amino acid position 238, from about amino acid position 245 to about amino acid position 265, and from about amino acid position 271 to about amino acid position 290 in the PRO281 amino acid sequence (FIG. 2, SEQ ID NO:2).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 15 to about 345, inclusive of FIG. 2 (SEQ ID NO:2), or (b) the complement of the DNA of (a).

Another embodiment is directed to fragments of a PRO281 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 1 (SEQ ID NO:1).

In another embodiment, the invention provides isolated PRO281 polypeptide encoded by any of the isolated nucleic acid sequences hereinabove identified.

In a specific aspect, the invention provides isolated native sequence PRO281 polypeptide, which in certain embodiments, includes an amino acid sequence comprising residues 1 or about 15 to about 345 of FIG. 2 (SEQ ID NO:2).

In another aspect, the invention concerns an isolated PRO281 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 15 to about 345, inclusive of FIG. 2 (SEQ ID NO:2).

In a further aspect, the invention concerns an isolated PRO281 polypeptide, comprising an amino acid sequence scoring at least about 80% positives, preferably at least about 85% positives, more preferably at least about 90% positives, most preferably at least about 95% positives when compared with the amino acid sequence of residues 1 or about 15 to about 345, inclusive of FIG. 2 (SEQ ID NO:2).

In yet another aspect, the invention concerns an isolated PRO281 polypeptide, comprising the sequence of amino acid residues 1 or about 15 to about 345, inclusive of FIG. 2 (SEQ ID NO:2), or a fragment thereof sufficient to provide a binding site for an anti-PRO281 antibody. Preferably, the PRO281 fragment retains a qualitative biological activity of a native PRO281 polypeptide.

In a still further aspect, the invention provides a polypeptide produced by (i) hybridizing a test DNA molecule under stringent conditions with (a) a DNA molecule encoding a PRO281 polypeptide having the sequence of amino acid residues from about 1 or about 15 to about 345, inclusive of FIG. 2 (SEQ ID NO:2), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO281 polypeptide. In a particular embodiment, the agonist or antagonist is an anti-PRO281 antibody.

In a further embodiment, the invention concerns a method of identifying agonists or antagonists of a native PRO281 polypeptide by contacting the native PRO281 polypeptide with a candidate molecule and monitoring a biological activity mediated by said polypeptide.

In a still further embodiment, the invention concerns a composition comprising a PRO281 polypeptide, or an agonist or antagonist as hereinabove defined, in combination with a pharmaceutically acceptable carrier.

2. PRO276

A cDNA clone (DNA16435-1208) has been identified that encodes a novel polypeptide having two transmembrane domains and designated in the present application as "PRO276."

In one embodiment, the invention provides an isolated nucleic acid molecule comprising DNA encoding a PRO276 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO276 polypeptide having the sequence of amino acid residues from about 1 to about 251, inclusive of FIG. 4 (SEQ ID NO:6), or (b) the complement of the DNA molecule of (a).

In another aspect, the invention concerns an isolated nucleic acid molecule encoding a PRO276 polypeptide comprising DNA hybridizing to the complement of the nucleic acid between about residues 180 and about 932, inclusive, of FIG. 3 (SEQ ID NO:5). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209930 (DNA16435-1208), or (b) the complement of the DNA molecule of (a). In a preferred embodiment, the nucleic acid comprises a DNA encoding the same mature polypeptide encoded by the human protein cDNA in ATCC Deposit No. 209930 (DNA16435-1208).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 251, inclusive of FIG. 4 (SEQ ID NO:6), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO276 polypeptide having the sequence of amino acid residues from about 1 to about 251, inclusive of FIG. 4 (SEQ ID NO:6), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO276 polypeptide in its soluble, i.e. transmembrane domains deleted or inactivated variants, or is complementary to such encoding nucleic acid molecule. The transmembrane domains are at about amino acids 98–116 and 152–172.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 251, inclusive of FIG. 4 (SEQ ID NO:6), or (b) the complement of the DNA of (a).

Another embodiment is directed to fragments of a PRO276 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO276 polypeptide encoded by any of the isolated nucleic acid sequences hereinabove defined.

In a specific aspect, the invention provides isolated native sequence PRO276 polypeptide, which in one embodiment, includes an amino acid sequence comprising residues 1 through 251 of FIG. 4 (SEQ ID NO:6).

In another aspect, the invention concerns an isolated PRO276 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 251, inclusive of FIG. 4 (SEQ ID NO:6).

In a further aspect, the invention concerns an isolated PRO276 polypeptide, comprising an amino acid sequence scoring at least about 80% positives, preferably at least about 85% positives, more preferably at least about 90% positives, most preferably at least about 95% positives when compared with the amino acid sequence of residues 1 through 251 of FIG. 4 (SEQ ID NO:6).

In yet another aspect, the invention concerns an isolated PRO276 polypeptide, comprising the sequence of amino acid residues 1 to about 251, inclusive of FIG. 4 (SEQ ID NO:6), or a fragment thereof sufficient to provide a binding site for an anti-PRO276 antibody. Preferably, the PRO276 fragment retains a qualitative biological activity of a native PRO276 polypeptide.

In a still further aspect, the invention provides a polypeptide produced by (i) hybridizing a test DNA molecule under stringent conditions with (a) a DNA molecule encoding a PRO276 polypeptide having the sequence of amino acid residues from about 1 to about 251, inclusive of FIG. 4 (SEQ ID NO:6), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO276 polypeptide. In a particular embodiment, the agonist or antagonist is an anti-PRO276 antibody.

In a further embodiment, the invention concerns a method of identifying agonists or antagonists of a native PRO276 polypeptide, by contacting the native PRO276 polypeptide with a candidate molecule and monitoring a biological activity mediated by said polypeptide.

In a still further embodiment, the invention concerns a composition comprising a PRO276 polypeptide, or an agonist or antagonist as hereinabove defined, in combination with a pharmaceutically acceptable carrier.

3. PRO189

A cDNA clone (DNA21624-1391) has been identified that encodes a novel polypeptide, designated in the present application as "PRO189". PRO189 polypeptides have a cytosolic fatty-acid binding domain.

In one embodiment, the invention provides an isolated nucleic acid molecule comprising DNA encoding a PRO189 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO189 polypeptide having the sequence of amino acid residues from about 1 to about 367, inclusive of FIG. 6 (SEQ ID NO:8), or (b) the complement of the DNA molecule of (a).

In another aspect, the invention concerns an isolated nucleic acid molecule encoding a PRO189 polypeptide comprising DNA hybridizing to the complement of the nucleic acid between about residues 200 and about 1300, inclusive, of FIG. 5 (SEQ ID NO:7). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209917 (DNA21624-1391), or (b) the complement of the DNA molecule of (a). In a preferred embodiment, the nucleic acid comprises a DNA encoding the same mature polypeptide encoded by the human protein cDNA in ATCC Deposit No. 209917 (DNA21624-1391).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 367, inclusive of FIG. 6 (SEQ ID NO:8), or the complement of the DNA of (a).

In a further aspect, the invention concerns an isolated nucleic acid molecule produced by hybridizing a test DNA molecule under stringent conditions with (a) a DNA molecule encoding a PRO189 polypeptide having the sequence of amino acid residues from about 1 to about 367, inclusive of FIG. 6 (SEQ ID NO:8), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 367, inclusive of FIG. 6 (SEQ ID NO:8), or (b) the complement of the DNA of (a).

In another embodiment, the invention provides isolated PRO189 polypeptide encoded by any of the isolated nucleic acid sequences hereinabove defined.

In a specific aspect, the invention provides isolated native sequence PRO189 polypeptide, which in one embodiment, includes an amino acid sequence comprising residues 1 through 367 of FIG. 6 (SEQ ID NO:8).

In another aspect, the invention concerns an isolated PRO189 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 367, inclusive of FIG. 6 (SEQ ID NO:8).

In a further aspect, the invention concerns an isolated PRO189 polypeptide, comprising an amino acid sequence scoring at least about 80% positives, preferably at least about 85% positives, more preferably at least about 90% positives, most preferably at least about 95% positives when compared with the amino acid sequence of residues 1 through 367 of FIG. 6 (SEQ ID NO:8).

In a still further aspect, the invention provides a polypeptide produced by (i) hybridizing a test DNA molecule under stringent conditions with (a) a DNA molecule encoding a PRO189 polypeptide having the sequence of amino acid residues from about 1 to about 367, inclusive of FIG. 6 (SEQ ID NO:8), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO189 polypeptide. In a particular embodiment, the agonist or antagonist is an anti-PRO189 antibody.

In a further embodiment, the invention concerns a method of identifying agonists or antagonists of a native PRO189 polypeptide, by contacting the native PRO189 polypeptide with a candidate molecule and monitoring a biological activity mediated by said polypeptide.

In a still further embodiment, the invention concerns a composition comprising a PRO189 polypeptide, or an agonist or antagonist as hereinabove defined, in combination with a pharmaceutically acceptable carrier.

4. PRO190

Applicants have identified a cDNA clone that encodes a novel polypeptide having seven transmembrane domains and having sequence identity with CMP-sialic acid and UDP-galactose transporters, wherein the polypeptide is designated in the present application as "PRO190".

In one embodiment, the invention provides an isolated nucleic acid molecule comprising DNA encoding a PRO190 polypeptide. In one aspect, the isolated nucleic acid comprises DNA encoding the PRO190 polypeptide having amino acid residues 1 through 424 of FIG. 9 (SEQ ID NO:14), or is complementary to such encoding nucleic acid sequence, and remains stably bound to it under at least moderate, and optionally, under high stringency conditions. The isolated nucleic acid sequence may comprise the cDNA insert of the vector deposited on Jun. 2, 1998 with the ATCC as DNA23334-1392 which includes the nucleotide sequence encoding PRO190.

In another embodiment, the invention provides isolated PRO190 polypeptide. In particular, the invention provides isolated native sequence PRO190 polypeptide, which in one embodiment, includes an amino acid sequence comprising residues 1 through 424 of FIG. 9 (SEQ ID NO:14). An additional embodiment of the present invention is directed to an isolated PRO190 polypeptide, excluding the transmembrane domains. Optionally, the PRO190 polypeptide is obtained or is obtainable by expressing the polypeptide encoded by the cDNA insert of the vector deposited on Jun. 2, 1998 with the ATCC as DNA23334-1392.

In another embodiment, the invention provides an expressed sequence tag (EST) comprising the nucleotide sequence of SEQ ID NO:15.

5. PRO341

A cDNA clone (DNA26288-1239) has been identified that encodes a novel transmembrane polypeptide, designated in the present application as "PRO341".

In one embodiment, the invention provides an isolated nucleic acid molecule comprising DNA encoding a PRO341 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO341 polypeptide having the sequence of amino acid residues from about 1 or about 18 to about 458, inclusive of FIG. 12 (SEQ ID NO:20), or (b) the complement of the DNA molecule of (a).

In another aspect, the invention concerns an isolated nucleic acid molecule encoding a PRO341 polypeptide comprising DNA hybridizing to the complement of the nucleic acid between about nucleotides 380 or about 431 and about 1753, inclusive, of FIG. 11 (SEQ ID NO:19). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209792 (DNA26288-1239) or (b) the complement of the nucleic acid molecule of (a). In a preferred embodiment, the nucleic acid comprises a DNA encoding the same mature polypeptide encoded by the human protein cDNA in ATCC Deposit No. 209792 (DNA26288-1239).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 18 to about 458, inclusive of FIG. 12 (SEQ ID NO:20), or (b) the complement of the DNA of (a).

In a further aspect, the invention concerns an isolated nucleic acid molecule having at least 165 nucleotides and produced by hybridizing a test DNA molecule under stringent conditions with (a) a DNA molecule encoding a PRO341 polypeptide having the sequence of amino acid residues from 1 or about 18 to about 458, inclusive of FIG. 12 (SEQ ID NO:20), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO341 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 17 in the sequence of FIG. 12 (SEQ ID NO:20). The transmembrane domains have been tentatively identified as extending from about amino acid position 171 to about amino acid position 190, from about amino acid position 220 to about amino acid position 239, from about amino acid position 259 to about amino acid position 275, from about amino acid position 286 to about amino acid position 305, from about amino acid position 316 to about amino acid position 335, from about amino acid position 353 to about amino acid position 378 and from about amino acid position 396 to about amino acid position 417 in the PRO341 amino acid sequence (FIG. 12, SEQ ID NO:20).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 18 to about 458, inclusive of FIG. 12 (SEQ ID NO:20), or (b) the complement of the DNA of (a).

Another embodiment is directed to fragments of a PRO341 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 11 (SEQ ID NO:19).

In another embodiment, the invention provides isolated PRO341 polypeptide encoded by any of the isolated nucleic acid sequences hereinabove identified.

In a specific aspect, the invention provides isolated native sequence PRO341 polypeptide, which in certain embodiments, includes an amino acid sequence comprising residues 1 or about 18 to about 458 of FIG. 12 (SEQ ID NO:20).

In another aspect, the invention concerns an isolated PRO341 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 18 to about 458, inclusive of FIG. 12 (SEQ ID NO:20).

In a further aspect, the invention concerns an isolated PRO341 polypeptide, comprising an amino acid sequence scoring at least about 80% positives, preferably at least about 85% positives, more preferably at least about 90% positives, most preferably at least about 95% positives when compared with the amino acid sequence of residues 1 or about 18 to about 458, inclusive of FIG. 12 (SEQ ID NO:20).

In yet another aspect, the invention concerns an isolated PRO341 polypeptide, comprising the sequence of amino acid residues 1 or about 18 to about 458, inclusive of FIG. 12 (SEQ ID NO:20), or a fragment thereof sufficient to provide a binding site for an anti-PRO341 antibody. Preferably, the PRO341 fragment retains a qualitative biological activity of a native PRO341 polypeptide.

In a still further aspect, the invention provides a polypeptide produced by (i) hybridizing a test DNA molecule under stringent conditions with (a) a DNA molecule encoding a PRO341 polypeptide having the sequence of amino acid residues from about 1 or about 18 to about 458, inclusive of FIG. 12 (SEQ ID NO:20), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides an expressed sequence tag (EST) designated herein as DNA12920 comprising the nucleotide sequence of SEQ ID NO:21 (see FIG. 13).

6. PRO180

A cDNA clone (DNA26843-1389) has been identified that encodes a novel polypeptide having multiple transmembrane domains designated in the present application as "PRO180".

In one embodiment, the invention provides an isolated nucleic acid molecule comprising DNA encoding a PRO180 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO180 polypeptide having the sequence of amino acid residues from about 1 to about 266, inclusive of FIG. 15 (SEQ ID NO:23), or (b) the complement of the DNA molecule of (a).

In another aspect, the invention concerns an isolated nucleic acid molecule encoding a PRO180 polypeptide comprising DNA hybridizing to the complement of the nucleic acid between about nucleotides 121 and about 918, inclusive, of FIG. 14 (SEQ ID NO:22). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203099 (DNA26843-1389), or (b) the complement of the DNA molecule of (a). In a preferred embodiment, the nucleic acid comprises a DNA encoding the same mature polypeptide encoded by the human protein cDNA in ATCC Deposit No. 203099 (DNA26843-1389).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 266, inclusive of FIG. 15 (SEQ ID NO:23), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO180 polypeptide having the sequence of amino acid residues from about 1 to about 266, inclusive of FIG. 15 (SEQ ID NO:23), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO180 polypeptide in its soluble form, i.e. transmembrane domains deleted or inactivated variants, or is complementary to such encoding nucleic acid molecule. The transmembrane domains are shown in FIG. 15. It is believed that PRO180 has a type II transmembrane domain from about amino acids 13–33 of SEQ ID NO:23.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 266, inclusive of FIG. 15 (SEQ ID NO:23), or (b) the complement of the DNA of (a).

Another embodiment is directed to fragments of a PRO180 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO180 polypeptide encoded by any of the isolated nucleic acid sequences hereinabove defined.

In a specific aspect, the invention provides isolated native sequence PRO180 polypeptide, which in one embodiment, includes an amino acid sequence comprising residues 1 through 266 of FIG. 15 (SEQ ID NO:23).

In another aspect, the invention concerns an isolated PRO180 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 266, inclusive of FIG. 15 (SEQ ID NO:23).

In a further aspect, the invention concerns an isolated PRO180 polypeptide, comprising an amino acid sequence scoring at least about 80% positives, preferably at least about 85% positives, more preferably at least about 90% positives, most preferably at least about 95% positives when compared with the amino acid sequence of residues 1 through 266 of FIG. 15 (SEQ ID NO:23).

In yet another aspect, the invention concerns an isolated PRO180 polypeptide, comprising the sequence of amino acid residues 1 to about 266, inclusive of FIG. 15 (SEQ ID NO:23), or a fragment thereof sufficient to provide a binding site for an anti-PRO180 antibody. Preferably, the PRO180 fragment retains a qualitative biological activity of a native PRO180 polypeptide.

In a still further aspect, the invention provides a polypeptide produced by (i) hybridizing a test DNA molecule under stringent conditions with (a) a DNA molecule encoding a PRO180 polypeptide having the sequence of amino acid residues from about 1 to about 266, inclusive of FIG. 15 (SEQ ID NO:23), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO180 polypeptide. In a particular embodiment, the agonist or antagonist is an anti-PRO180 antibody.

In a further embodiment, the invention concerns a method of identifying agonists or antagonists of a native PRO180 polypeptide, by contacting the native PRO180 polypeptide with a candidate molecule and monitoring a biological activity mediated by said polypeptide.

In a still further embodiment, the invention concerns a composition comprising a PRO180 polypeptide, or an agonist or antagonist as hereinabove defined, in combination with a pharmaceutically acceptable carrier.

In another embodiment, the invention provides an expressed sequence tag (EST) (DNA12922) comprising the nucleotide sequence of FIG. 16 (SEQ ID NO:24).

7. PRO194

Applicants have identified a cDNA clone that encodes a novel transmembrane polypeptide, wherein the polypeptide is designated in the present application as "PRO194".

In one embodiment, the invention provides an isolated nucleic acid molecule comprising DNA encoding a PRO194 polypeptide. In one aspect, the isolated nucleic acid comprises DNA encoding the PRO194 polypeptide having amino acid residues 1 to 264 of FIG. 18 (SEQ ID NO:28), or is complementary to such encoding nucleic acid sequence, and remains stably bound to it under at least moderate, and optionally, under high stringency conditions. In other aspects, the isolated nucleic acid comprises DNA encoding the PRO194 polypeptide having amino acid residues about 18 to 264 of FIG. 18 (SEQ ID NO:28) or amino acid 1 or about 18 to X of FIG. 18 (SEQ ID NO:28), where X is any amino acid from 96 to 105 of FIG. 18 (SEQ ID NO:28), or is complementary to such encoding nucleic acid sequence, and remains stably bound to it under at least moderate, and optionally, under high stringency conditions. The isolated nucleic acid sequence may comprise the cDNA insert of the DNA26844-1394 vector deposited on Jun. 2, 1998 as ATCC 209926 which includes the nucleotide sequence encoding PRO194.

In another embodiment, the invention provides isolated PRO194 polypeptide. In particular, the invention provides isolated native sequence PRO194 polypeptide, which in one embodiment, includes an amino acid sequence comprising residues 1 to 264 of FIG. 18 (SEQ ID NO:28). Additional embodiments of the present invention are directed to PRO194 polypeptides comprising amino acids about 18 to 264 of FIG. 18 (SEQ ID NO:28) or amino acid 1 or about 18 to X of FIG. 18 (SEQ ID NO:28), where X is any amino acid from 96 to 105 of FIG. 18 (SEQ ID NO:28). Optionally, the PRO194 polypeptide is obtained or is obtainable by expressing the polypeptide encoded by the cDNA insert of the DNA26844-1394 vector deposited on Jun. 2, 1998 as ATCC 209926.

8. PRO203

Applicants have identified a cDNA clone that encodes a novel polypeptide having sequence identity to glutathione-S-transferase, wherein the polypeptide is designated in the present application as "PRO203".

In one embodiment, the invention provides an isolated nucleic acid molecule comprising DNA encoding a PRO203 polypeptide. In one aspect, the isolated nucleic acid comprises DNA encoding the PRO203 polypeptide having amino acid residues 1 to 347 of FIG. 20 (SEQ ID NO:30), or is complementary to such encoding nucleic acid sequence, and remains stably bound to it under at least moderate, and optionally, under high stringency conditions. In other aspects, the isolated nucleic acid comprises DNA encoding the PRO203 polypeptide having amino acid residues X to 347 of FIG. 20 (SEQ ID NO:30), where X is any amino acid from 83 to 92 of FIG. 20 (SEQ ID NO:30), or is complementary to such encoding nucleic acid sequence, and remains stably bound to it under at least moderate, and optionally, under high stringency conditions. The isolated nucleic acid sequence may comprise the cDNA insert of the DNA30862-1396 vector deposited on Jun. 2, 1998, as ATCC 209920 which includes the nucleotide sequence encoding PRO203.

In another embodiment, the invention provides isolated PRO203 polypeptide. In particular, the invention provides isolated native sequence PRO203 polypeptide, which in one embodiment, includes an amino acid sequence comprising residues 1 to 347 of FIG. 20 (SEQ ID NO:30). Additional embodiments of the present invention are directed to PRO203 polypeptides comprising amino acid X to 347 of FIG. 20 (SEQ ID NO:30), where X is any amino acid from 83 to 92 of FIG. 20 (SEQ ID NO:30). Optionally, the PRO203 polypeptide is obtained or is obtainable by expressing the polypeptide encoded by the cDNA insert of the DNA30862-1396 vector deposited on Jun. 2, 1998, as ATCC 209920.

In another embodiment, the invention provides an expressed sequence tag (EST) designated herein as DNA15618 which comprises the nucleotide sequence of FIG. 21 (SEQ ID NO:31).

9. PRO290

A cDNA clone (DNA35680-1212) has been identified which encodes a polypeptide designated in the present application as "PRO290." PRO290 polypeptides have sequence identity with NTII-1, FAN and beige.

In one embodiment, the invention provides an isolated nucleic acid molecule comprising DNA encoding a PRO290 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO290 polypeptide having the sequence of amino acid residues from about 1 to about 1003, inclusive of FIG. 23 (SEQ ID NO:33), or (b) the complement of the DNA molecule of (a).

In another aspect, the invention concerns an isolated nucleic acid molecule encoding a PRO290 polypeptide comprising DNA hybridizing to the complement of the nucleic acid between about residues 293 and about 3301, inclusive, of FIG. 22 (SEQ ID NO:32). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209790 (DNA35680-1212), or (b) the complement of the DNA molecule of (a). In a preferred embodiment, the nucleic acid comprises a DNA encoding the same mature polypeptide encoded by the human protein cDNA in ATCC Deposit No. 209790 (DNA35680-1212).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 1003, inclusive of FIG. 23 (SEQ ID NO:33), or the complement of the DNA of (a).

In a further aspect, the invention concerns an isolated nucleic acid molecule produced by hybridizing a test DNA molecule under stringent conditions with (a) a DNA molecule encoding a PRO290 polypeptide having the sequence of amino acid residues from about 1 to about 1003, inclusive of FIG. 23 (SEQ ID NO:33), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 1003, inclusive of FIG. 23 (SEQ ID NO:33), or (b) the complement of the DNA of (a).

In another embodiment, the invention provides isolated PRO290 polypeptide encoded by any of the isolated nucleic acid sequences hereinabove defined.

In a specific aspect, the invention provides isolated native sequence PRO290 polypeptide, which in one embodiment, includes an amino acid sequence comprising residues 1 through 1003 of FIG. 23 (SEQ ID NO:33).

In another aspect, the invention concerns an isolated PRO290 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 1003, inclusive of FIG. 23 (SEQ ID NO:33).

In a further aspect, the invention concerns an isolated PRO290 polypeptide, comprising an amino acid sequence scoring at least about 80% positives, preferably at least about 85% positives, more preferably at least about 90% positives, most preferably at least about 95% positives when compared with the amino acid sequence of residues 1 through 1003 of FIG. 23 (SEQ ID NO:33).

In a still further aspect, the invention provides a polypeptide produced by (i) hybridizing a test DNA molecule under stringent conditions with (a) a DNA molecule encoding a PRO290 polypeptide having the sequence of amino acid residues from about 1 to about 1003, inclusive of FIG. 23 (SEQ ID NO:33), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO290 polypeptide. In a particular embodiment, the agonist or antagonist is an anti-PRO290 antibody.

In a further embodiment, the invention concerns a method of identifying agonists or antagonists of a native PRO290 polypeptide, by contacting the native PRO290 polypeptide with a candidate molecule and monitoring a biological activity mediated by said polypeptide.

In a still further embodiment, the invention concerns a composition comprising a PRO290 polypeptide, or an agonist or antagonist as hereinabove defined, in combination with a pharmaceutically acceptable carrier.

10. PRO874

Applicants have identified a cDNA clone that encodes a novel multi-span transmembrane polypeptide, which is designated in the present application as "PRO874".

In one embodiment, the invention provides an isolated nucleic acid molecule comprising DNA encoding a PRO874 polypeptide. In one aspect, the isolated nucleic acid comprises DNA encoding the PRO874 polypeptide having amino acid residues 1 to 321 of FIG. 25 (SEQ ID NO:36), or is complementary to such encoding nucleic acid sequence, and remains stably bound to it under at least moderate, and optionally, under high stringency conditions. In other aspects, the isolated nucleic acid comprises DNA encoding the PRO874 polypeptide having amino acid from about X to 321 of FIG. 25 (SEQ ID NO:36), where X is any amino acid from about 270 to about 279 of FIG. 25 (SEQ ID NO:36), or is complementary to such encoding nucleic acid sequence, and remains stably bound to it under at least moderate, and optionally, under high stringency conditions. The isolated nucleic acid sequence may comprise the cDNA insert of the DNA40621-1440 vector deposited on Jun. 2, 1998, as ATCC 209922 which includes the nucleotide sequence encoding PRO874.

In another embodiment, the invention provides isolated PRO874 polypeptide. In particular, the invention provides isolated native sequence PRO874 polypeptide, which in one embodiment, includes an amino acid sequence comprising residues 1 to 321 of FIG. 25 (SEQ ID NO:36). Additional embodiments of the present invention are directed to PRO874 polypeptides comprising amino acids X to 321 of FIG. 25 (SEQ ID NO:36), where X is any amino acid from about 270 to about 279 of FIG. 25 (SEQ ID NO:36). Optionally, the PRO874 polypeptide is obtained or is obtainable by expressing the polypeptide encoded by the cDNA insert of the DNA40621-1440 vector deposited on Jun. 2, 1998, as ATCC 209922.

11. PRO710

Applicants have identified a cDNA clone that encodes a novel polypeptide having homology to CDC45 protein, wherein the polypeptide is designated in the present application as "PRO710".

In one embodiment, the invention provides an isolated nucleic acid molecule comprising DNA encoding a PRO710 polypeptide. In one aspect, the isolated nucleic acid comprises DNA encoding the PRO710 polypeptide having amino acid residues 1 to 566 of FIG. 27 (SEQ ID NO:41), or is complementary to such encoding nucleic acid sequence, and remains stably bound to it under at least moderate, and optionally, under high stringency conditions. In other aspects, the isolated nucleic acid comprises DNA encoding the PRO710 polypeptide having amino acid residues about 33 to 566 of FIG. 27 (SEQ ID NO:41) or amino acid 1 or about 33 to X of FIG. 27 (SEQ ID NO:41), where X is any amino acid from 449 to 458 of FIG. 27 (SEQ ID NO:41), or is complementary to such encoding nucleic acid sequence, and remains stably bound to it under at least moderate, and optionally, under high stringency conditions. The isolated nucleic acid sequence may comprise the cDNA insert of the DNA44161-1434 vector deposited on May 27, 1998 as ATCC 209907 which includes the nucleotide sequence encoding PRO710.

In another embodiment, the invention provides isolated PRO710 polypeptide. In particular, the invention provides isolated native sequence PRO710 polypeptide, which in one embodiment, includes an amino acid sequence comprising residues 1 to 566 of FIG. 27 (SEQ ID NO:41). Additional embodiments of the present invention are directed to PRO710 polypeptides comprising amino acids about 33 to 566 of FIG. 27 (SEQ ID NO:41) or amino acid 1 or about 33 to X of FIG. 27 (SEQ ID NO:41), where X is any amino acid from 449 to 458 of FIG. 27 (SEQ ID NO:41). Optionally, the PRO710 polypeptide is obtained or is obtainable by expressing the polypeptide encoded by the cDNA insert of the DNA44161-1434 vector deposited on May 27, 1998 as ATCC 209907.

In another embodiment, the invention provides an expressed sequence tag (EST) designated herein as DNA38190 comprising the nucleotide sequence of FIG. 28 (SEQ ID NO:42).

12. PRO1151

A cDNA clone (DNA44694-1500) has been identified, having homology to nucleic acid encoding C1q protein, that encodes a novel polypeptide, designated in the present application as "PRO1151".

In one embodiment, the invention provides an isolated nucleic acid molecule comprising DNA encoding a PRO1151 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1151 polypeptide having the sequence of amino acid residues from about 1 or about 21 to about 259, inclusive of FIG. 30 (SEQ ID NO:47), or (b) the complement of the DNA molecule of (a).

In another aspect, the invention concerns an isolated nucleic acid molecule encoding a PRO1151 polypeptide comprising DNA hybridizing to the complement of the nucleic acid between about nucleotides 272 or about 332 and about 1048, inclusive, of FIG. 29 (SEQ ID NO:46). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203114 (DNA44694-1500) or (b) the complement of the nucleic acid molecule of (a). In a preferred embodiment, the nucleic acid comprises a DNA encoding the same mature polypeptide encoded by the human protein cDNA in ATCC Deposit No. 203114 (DNA44694-1500).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 21 to about 259, inclusive of FIG. 30 (SEQ ID NO:47), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1151 polypeptide having the sequence of amino acid residues from 1 or about 21 to about 259, inclusive of FIG. 30 (SEQ ID NO:47), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1151 polypeptide, with or without the N-terminal signal sequence and/or the initiating methionine, or is complementary to such encoding nucleic acid molecule. The signal peptide has been tentatively identified as extending from about amino acid position 1 to about amino acid position 20 in the sequence of FIG. 30 (SEQ ID NO:47).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 21 to about 259, inclusive of FIG. 30 (SEQ ID NO:47), or (b) the complement of the DNA of (a).

Another embodiment is directed to fragments of a PRO1151 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 29 (SEQ ID NO:46).

In another embodiment, the invention provides isolated PRO1151 polypeptide encoded by any of the isolated nucleic acid sequences hereinabove identified.

In a specific aspect, the invention provides isolated native sequence PRO1151 polypeptide, which in certain embodiments, includes an amino acid sequence comprising residues 1 or about 21 to about 259 of FIG. 30 (SEQ ID NO:47).

In another aspect, the invention concerns an isolated PRO1151 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 21 to about 259, inclusive of FIG. 30 (SEQ ID NO:47).

In a further aspect, the invention concerns an isolated PRO1151 polypeptide, comprising an amino acid sequence scoring at least about 80% positives, preferably at least about 85% positives, more preferably at least about 90% positives, most preferably at least about 95% positives when compared with the amino acid sequence of residues 1 or about 21 to about 259, inclusive of FIG. 30 (SEQ ID NO:47).

In yet another aspect, the invention concerns an isolated PRO1151 polypeptide, comprising the sequence of amino acid residues 1 or about 21 to about 259, inclusive of FIG. 30 (SEQ ID NO:47), or a fragment thereof sufficient to provide a binding site for an anti-PRO1151 antibody.

Preferably, the PRO1151 fragment retains a qualitative biological activity of a native PRO1151 polypeptide.

In a still further aspect, the invention provides a polypeptide produced by (i) hybridizing a test DNA molecule under stringent conditions with (a) a DNA molecule encoding a PRO1151 polypeptide having the sequence of amino acid residues from about 1 or about 21 to about 259, inclusive of FIG. 30 (SEQ ID NO:47), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1151 polypeptide. In a particular embodiment, the agonist or antagonist is an anti-PRO1151 antibody.

In a further embodiment, the invention concerns a method of identifying agonists or antagonists of a native PRO1151 polypeptide by contacting the native PRO1151 polypeptide with a candidate molecule and monitoring a biological activity mediated by said polypeptide.

In a still further embodiment, the invention concerns a composition comprising a PRO1151 polypeptide, or an agonist or antagonist as hereinabove defined, in combination with a pharmaceutically acceptable carrier.

13. PRO1282

A cDNA clone (DNA45495-1550) has been identified that encodes a novel polypeptide having sequence identity with leucine rich repeat proteins and designated in the present application as "PRO1282."

In one embodiment, the invention provides an isolated nucleic acid molecule comprising DNA encoding a PRO1282 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1282 polypeptide having the sequence of amino acid residues from about 24 to about 673, inclusive of FIG. 32 (SEQ ID NO:52), or (b) the complement of the DNA molecule of (a).

In another aspect, the invention concerns an isolated nucleic acid molecule encoding a PRO1282 polypeptide comprising DNA hybridizing to the complement of the nucleic acid between about residues 189 and about 2138, inclusive, of FIG. 31 (SEQ ID NO:51). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203156 (DNA45495-1550), or (b) the complement of the DNA molecule of (a). In a preferred embodiment, the nucleic acid comprises a DNA encoding the same mature polypeptide encoded by the human protein cDNA in ATCC Deposit No. 203156 (DNA45495-1550).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 24 to about 673, inclusive of FIG. 32 (SEQ ID NO:52), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1282 polypeptide having the sequence of amino acid residues from about 24 to about 673, inclusive of FIG. 32 (SEQ ID NO:52), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1282 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 23 in the sequence of FIG. 32 (SEQ ID NO:52). The transmembrane domain has been tentatively identified as extending from about amino acid position 579 through about amino acid position 599 in the PRO1282 amino acid sequence (FIG. 32, SEQ ID NO:52).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 24 to about 673, inclusive of FIG. 32 (SEQ ID NO:52), or (b) the complement of the DNA of (a).

Another embodiment is directed to fragments of a PRO1282 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1282 polypeptide encoded by any of the isolated nucleic acid sequences hereinabove defined.

In a specific aspect, the invention provides isolated native sequence PRO1282 polypeptide, which in one embodiment, includes an amino acid sequence comprising residues 24 through 673 of FIG. 32 (SEQ ID NO:52).

In another aspect, the invention concerns an isolated PRO1282 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 24 to about 673, inclusive of FIG. 32 (SEQ ID NO:52).

In a further aspect, the invention concerns an isolated PRO1282 polypeptide, comprising an amino acid sequence scoring at least about 80% positives, preferably at least about 85% positives, more preferably at least about 90% positives, most preferably at least about 95% positives when compared with the amino acid sequence of residues 24 through 673 of FIG. 32 (SEQ ID NO:52).

In yet another aspect, the invention concerns an isolated PRO1282 polypeptide, comprising the sequence of amino acid residues 24 to about 673, inclusive of FIG. 32 (SEQ ID NO:52), or a fragment thereof sufficient to provide a binding site for an anti-PRO1282 antibody. Preferably, the PRO1282 fragment retains a qualitative biological activity of a native PRO1282 polypeptide.

In a still further aspect, the invention provides a polypeptide produced by (i) hybridizing a test DNA molecule under stringent conditions with (a) a DNA molecule encoding a PRO1282 polypeptide having the sequence of amino acid residues from about 24 to about 673, inclusive of FIG. 32 (SEQ ID NO:52), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1282 polypeptide. In a particular embodiment, the agonist or antagonist is an anti-PRO1282 antibody.

In a further embodiment, the invention concerns a method of identifying agonists or antagonists of a native PRO1282 polypeptide, by contacting the native PRO1282 polypeptide with a candidate molecule and monitoring a biological activity mediated by said polypeptide.

In a still further embodiment, the invention concerns a composition comprising a PRO1282 polypeptide, or an agonist or antagonist as hereinabove defined, in combination with a pharmaceutically acceptable carrier.

14. PRO358

Applicants have identified a novel cDNA clone that encodes novel human Toll polypeptides, designated in the present application as PRO358.

In one embodiment, the invention provides an isolated nucleic acid molecule comprising a DNA encoding a polypeptide having at least about 80% sequence identity, preferably at least about 85% sequence identity, more preferably at least about 90% sequence identity, most preferably at least about 95% sequence identity to (a) a DNA molecule encoding a PRO358 polypeptide having amino acids 20 to 575 of FIG. 34 (SEQ ID NO:57), or (b) the complement of the DNA molecule of (a). The complementary DNA molecule preferably remains stably bound to such encoding nucleic acid sequence under at least moderate, and optionally, under high stringency conditions.

In a further embodiment, the isolated nucleic acid molecule comprises a polynucleotide that has at least about 90%, preferably at least about 95% sequence identity with a polynucleotide encoding a polypeptide comprising the sequence of amino acids 1 to 811 of FIG. 34 (SEQ ID NO:57).

In a specific embodiment, the invention provides an isolated nucleic acid molecule comprising DNA encoding native or variant PRO358 polypeptide, with or without the N-terminal signal sequence, and with or without the transmembrane regions of the respective full-length sequences. In one aspect, the isolated nucleic acid comprises DNA encoding a mature, full-length native PRO358 polypeptide having amino acid residues 1 to 811 of FIG. 34 (SEQ ID NO:57), or is complementary to such encoding nucleic acid sequence. In another aspect, the invention concerns an isolated nucleic acid molecule that comprises DNA encoding a native PRO358 polypeptide without an N-terminal signal sequence, or is complementary to such encoding nucleic acid sequence. In yet another embodiment, the invention concerns nucleic acid encoding transmembrane-domain deleted or inactivated forms of the full-length native PRO358 protein.

In another embodiment, the invention provides an isolated nucleic acid molecule which comprises the clone (DNA47361-1249) deposited on Nov. 7, 1997, under ATCC number 209431.

In a specific embodiment, the invention provides a vector comprising a polynucleotide having at least about 80% sequence identity, preferably at least about 85% sequence identity, more preferably at least about 90% sequence identity, most preferably at least about 95% sequence identity with a polynucleotide encoding a polypeptide comprising the sequence of amino acids 20 to 811 of FIG. 34 (SEQ ID NO:57), or the complement of such polynucleotide. In a particular embodiment, the vector comprises DNA encoding the novel Toll homologue (PRO358), with or without the N-terminal signal sequence (about amino acids 1 to 19), or a transmembrane-domain (about amino acids 576–595) deleted or inactivated variant thereof, or the extracellular domain (about amino acids 20 to 595) of the mature protein, or a protein comprising any one of these sequences. A host cell comprising such a vector is also provided.

In another embodiment, the invention provides isolated PRO358 polypeptides. The invention further provides an isolated native sequence PRO358 polypeptide, or variants thereof. In particular, the invention provides an isolated native sequence PRO358 polypeptide, which in certain embodiments, includes the amino acid sequence comprising residues 20 to 575, or 20 to 811, or 1 to 811 of FIG. 34 (SEQ ID NO:57).

In yet another embodiment, the invention concerns agonists and antagonists of the native PRO358 polypeptide. In a particular embodiment, the agonist or antagonist is an anti-PRO358 antibody.

In a further embodiment, the invention concerns screening assays to identify agonists or antagonists of the native PRO358 polypeptide.

In a still further embodiment, the invention concerns a composition comprising a PRO358 polypeptide, or an agonist or antagonist as hereinabove defined, in combination with a pharmaceutically acceptable carrier.

The invention further concerns a composition comprising an antibody specifically binding a PRO358 polypeptide, in combination with a pharmaceutically acceptable carrier.

The invention also concerns a method of treating septic shock comprising administering to a patient an effective amount of an antagonist of a PRO358 polypeptide. In a specific embodiment, the antagonist is a blocking antibody specifically binding a native PRO358 polypeptide.

15. PRO1310

A cDNA clone (DNA47394-1572) has been identified that encodes a novel polypeptide having sequence identity with carboxypeptidase X2 and designated in the present application as "PRO1310."

In one embodiment, the invention provides an isolated nucleic acid molecule comprising DNA encoding a PRO1310 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1310 polypeptide having the sequence of amino acid residues from about 26 to about 765, inclusive of FIG. 36 (SEQ ID NO:62), or (b) the complement of the DNA molecule of (a).

In another aspect, the invention concerns an isolated nucleic acid molecule encoding a PRO1310 polypeptide comprising DNA hybridizing to the complement of the nucleic acid between about residues 401 and about 2593, inclusive, of FIG. 35 (SEQ ID NO:61). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203109 (DNA47394-1572), or (b) the complement of the DNA molecule of (a). In a preferred embodiment, the nucleic acid comprises a DNA encoding the same mature polypeptide encoded by the human protein cDNA in ATCC Deposit No. 203109 (DNA47394-1572).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 26 to about 765, inclusive of FIG. 36 (SEQ ID NO:62), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1310 polypeptide having the sequence of amino acid residues from about 26 to about 765, inclusive of FIG. 36 (SEQ ID NO:62), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 26 to about 765, inclusive of FIG. 36 (SEQ ID NO:62), or (b) the complement of the DNA of (a).

In another embodiment, the invention provides isolated PRO1310 polypeptide encoded by any of the isolated nucleic acid sequences hereinabove defined.

In a specific aspect, the invention provides isolated native sequence PRO1310 polypeptide, which in one embodiment, includes an amino acid sequence comprising residues 26 through 765 of FIG. 36 (SEQ ID NO:62).

In another aspect, the invention concerns an isolated PRO1310 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 26 to about 765, inclusive of FIG. 36 (SEQ ID NO:62).

In a further aspect, the invention concerns an isolated PRO1310 polypeptide, comprising an amino acid sequence scoring at least about 80% positives, preferably at least about 85% positives, more preferably at least about 90% positives, most preferably at least about 95% positives when compared with the amino acid sequence of residues 26 through 765 of FIG. 36 (SEQ ID NO:62).

In yet another aspect, the invention concerns an isolated PRO1310 polypeptide, comprising the sequence of amino acid residues 26 to about 765, inclusive of FIG. 36 (SEQ ID NO:62), or a fragment thereof sufficient to provide a binding site for an anti-PRO1310 antibody. Preferably, the PRO1310 fragment retains a qualitative biological activity of a native PRO1310 polypeptide.

In a still further aspect, the invention provides a polypeptide produced by (i) hybridizing a test DNA molecule under stringent conditions with (a) a DNA molecule encoding a PRO1310 polypeptide having the sequence of amino acid residues from about 26 to about 765, inclusive of FIG. 36 (SEQ ID NO:62), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1310 polypeptide. In a particular embodiment, the agonist or antagonist is an anti-PRO1310 antibody.

In a further embodiment, the invention concerns a method of identifying agonists or antagonists of a native PRO1310 polypeptide, by contacting the native PRO1310 polypeptide with a candidate molecule and monitoring a biological activity mediated by said polypeptide.

In a still further embodiment, the invention concerns a composition comprising a PRO1310 polypeptide, or an agonist or antagonist as hereinabove defined, in combination with a pharmaceutically acceptable carrier.

16. PRO698

Applicants have identified a cDNA clone that encodes a novel polypeptide having homology to olfactomedin, wherein the polypeptide is designated in the present application as "PRO698".

In one embodiment, the invention provides an isolated nucleic acid molecule comprising DNA encoding a PRO698 polypeptide. In one aspect, the isolated nucleic acid comprises DNA encoding the PRO698 polypeptide having amino acid residues 1 to 510 of FIG. 38 (SEQ ID NO:67), or is complementary to such encoding nucleic acid sequence, and remains stably bound to it under at least moderate, and optionally, under high stringency conditions. In other aspects, the isolated nucleic acid comprises DNA encoding the PRO698 polypeptide having amino acid residues about 21 to 510 of FIG. 38 (SEQ ID NO:67), or is complementary to such encoding nucleic acid sequence, and remains stably bound to it under at least moderate, and optionally, under high stringency conditions. The isolated nucleic acid sequence may comprise the cDNA insert of the DNA48320-1433 vector deposited on May 27, 1998 as ATCC 209904 which includes the nucleotide sequence encoding PRO698.

In another embodiment, the invention provides isolated PRO698 polypeptide. In particular, the invention provides isolated native sequence PRO698 polypeptide, which in one embodiment, includes an amino acid sequence comprising residues 1 to 510 of FIG. 38 (SEQ ID NO:67). Additional embodiments of the present invention are directed to PRO698 polypeptides comprising amino acids about 21 to 510 of FIG. 38 (SEQ ID NO:67). Optionally, the PRO698 polypeptide is obtained or is obtainable by expressing the polypeptide encoded by the cDNA insert of the DNA48320-1433 vector deposited on May 27, 1998 as ATCC 209904.

In another embodiment, the invention provides an expressed sequence tag (EST) designated herein as DNA39906 comprising the nucleotide sequence of FIG. 39 (SEQ ID NO:68).

17. PRO732

Applicants have identified a cDNA clone that encodes a novel polypeptide having homology to the human placental protein Diff33, wherein the polypeptide is designated in the present application as "PRO732".

In one embodiment, the invention provides an isolated nucleic acid molecule comprising DNA encoding a PRO732 polypeptide. In one aspect, the isolated nucleic acid comprises DNA encoding the PRO732 polypeptide having amino acid residues 1 to 453 of FIG. 41 (SEQ ID NO:73), or is complementary to such encoding nucleic acid sequence, and remains stably bound to it under at least moderate, and optionally, under high stringency conditions. In other aspects, the isolated nucleic acid comprises DNA encoding the PRO732 polypeptide having amino acid residues about 29 to 453 of FIG. 41 (SEQ ID NO:73) or amino acid 1 or about 29 to X of FIG. 41 (SEQ ID NO:73), where X is any amino acid from 31 to 40 of FIG. 41 (SEQ ID NO:73), or is complementary to such encoding nucleic acid sequence, and remains stably bound to it under at least moderate, and optionally, under high stringency conditions. The isolated nucleic acid sequence may comprise the cDNA insert of the DNA48334-1435 vector deposited on Jun. 2, 1998 as ATCC 209924 which includes the nucleotide sequence encoding PRO732.

In another embodiment, the invention provides isolated PRO732 polypeptide. In particular, the invention provides isolated native sequence PRO732 polypeptide, which in one embodiment, includes an amino acid sequence comprising residues 1 to 453 of FIG. 41 (SEQ ID NO:73). Additional embodiments of the present invention are directed to PRO732 polypeptides comprising amino acids about 29 to 453 of FIG. 41 (SEQ ID NO:73) or amino acid 1 or about 29 to X of FIG. 41 (SEQ ID NO:73), where X is any amino acid from 31 to 40 of FIG. 41 (SEQ ID NO:73). Optionally, the PRO732 polypeptide is obtained or is obtainable by expressing the polypeptide encoded by the cDNA insert of the DNA48334-1435 vector deposited on Jun. 2, 1998 as ATCC 209924.

In another embodiment, the invention provides an expressed sequence tag (EST) designated herein as DNA20239 comprising the nucleotide sequence of FIG. 42 (SEQ ID NO:74).

In another embodiment, the invention provides an expressed sequence tag (EST) designated herein as DNA38050 comprising the nucleotide sequence of FIG. 43 (SEQ ID NO:75).

In another embodiment, the invention provides an expressed sequence tag (EST) designated herein as DNA40683 comprising the nucleotide sequence of FIG. 44 (SEQ ID NO:76).

In another embodiment, the invention provides an expressed sequence tag (EST) designated herein as DNA42580 comprising the nucleotide sequence of FIG. 45 (SEQ ID NO:77).

18. PRO1120

A cDNA clone (DNA48606-1479) has been identified that encodes a novel polypeptide having homology sulfatases, designated in the present application as "PRO1120."

In one embodiment, the invention provides an isolated nucleic acid molecule comprising DNA encoding a PRO1120 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1120 polypeptide having the sequence of amino acid residues from about 18 to about 867, inclusive of FIG. 47 (SEQ ID NO:84), or (b) the complement of the DNA molecule of (a).

In another aspect, the invention concerns an isolated nucleic acid molecule encoding a PRO1120 polypeptide comprising DNA hybridizing to the complement of the nucleic acid between about residues 659 and about 3208, inclusive, of FIG. 46 (SEQ ID NO:83). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203040 (DNA48606-1479), or (b) the complement of the DNA molecule of (a). In a preferred embodiment, the nucleic acid comprises a DNA encoding the same mature polypeptide encoded by the human protein cDNA in ATCC Deposit No. 203040 (DNA48606-1479).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 867, inclusive of FIG. 47 (SEQ ID NO:84), or the complement of the DNA of (a).

In a further aspect, the invention concerns an isolated nucleic acid molecule having at least about 50 nucleotides and preferably at least about 100 nucleotides and produced by hybridizing a test DNA molecule under stringent conditions with (a) a DNA molecule encoding a PRO1120 polypeptide having the sequence of amino acid residues from about 18 to about 867, inclusive of FIG. 47 (SEQ ID NO:84), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1120 polypeptide, with or without the N-terminal signal sequence, or is complementary to such encoding nucleic acid molecule. The signal peptide has been tentatively identified as extending from amino acid position 1 through about amino acid position 17 in the sequence of FIG. 47 (SEQ ID NO:84).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 867, inclusive of FIG. 47 (SEQ ID NO:84), or (b) the complement of the DNA of (a).

Another embodiment is directed to fragments of a PRO1120 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1120 polypeptide encoded by any of the isolated nucleic acid sequences hereinabove defined.

In a specific aspect, the invention provides isolated native sequence PRO1120 polypeptide, which in one embodiment, includes an amino acid sequence comprising residues 18 to 867 of FIG. 47 (SEQ ID NO:84).

In another aspect, the invention concerns an isolated PRO1120 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 867, inclusive of FIG. 47 (SEQ ID NO:84).

In a further aspect, the invention concerns an isolated PRO1120 polypeptide, comprising an amino acid sequence scoring at least about 80% positives, preferably at least about 85% positives, more preferably at least about 90% positives, most preferably at least about 95% positives when compared with the amino acid sequence of residues 18 to 867 of FIG. 47 (SEQ ID NO:84).

In yet another aspect, the invention concerns an isolated PRO1120 polypeptide, comprising the sequence of amino acid residues 18 to about 867, inclusive of FIG. 47 (SEQ ID NO:84), or a fragment thereof sufficient to provide a binding site for an anti-PRO1120 antibody. Preferably, the PRO1120 fragment retains a qualitative biological activity of a native PRO1120 polypeptide.

In a still further aspect, the invention provides a polypeptide produced by (i) hybridizing a test DNA molecule under stringent conditions with (a) a DNA molecule encoding a PRO1120 polypeptide having the sequence of amino acid residues from about 18 to about 867, inclusive of FIG. 47 (SEQ ID NO:84), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1120 polypeptide. In a particular embodiment, the agonist or antagonist is an anti-PRO1120 antibody.

In a further embodiment, the invention concerns a method of identifying agonists or antagonists of a native PRO1120 polypeptide, by contacting the native PRO1120 polypeptide with a candidate molecule and monitoring a biological activity mediated by said polypeptide.

In a still further embodiment, the invention concerns a composition comprising a PRO1120 polypeptide, or an agonist or antagonist as hereinabove defined, in combination with a pharmaceutically acceptable carrier.

19. PRO537

A cDNA clone (DNA49141-1431) has been identified that encodes a novel secreted polypeptide, designated in the present application as "PRO537".

In one embodiment, the invention provides an isolated nucleic acid molecule comprising DNA encoding a PRO537 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO537 polypeptide having the sequence of amino acid residues from about 1 or about 32 to about 115, inclusive of FIG. 49 (SEQ ID NO:95), or (b) the complement of the DNA molecule of (a).

In another aspect, the invention concerns an isolated nucleic acid molecule encoding a PRO537 polypeptide comprising DNA hybridizing to the complement of the nucleic acid between about nucleotides 97 or about 190 and about 441, inclusive, of FIG. 48 (SEQ ID NO:94). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203003 (DNA49141-1431) or (b) the complement of the nucleic acid molecule of (a). In a preferred embodiment, the nucleic acid comprises a DNA encoding the same mature polypeptide encoded by the human protein cDNA in ATCC Deposit No. 203003 (DNA49141-1431).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 32 to about 115, inclusive of FIG. 49 (SEQ ID NO:95), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO537 polypeptide having the sequence of amino acid residues from 1 or about 32 to about 115, inclusive of FIG. 49 (SEQ ID NO:95), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO537 polypeptide, with or without the N-terminal signal sequence and/or the initiating methionine, or is complementary to such encoding nucleic acid molecule. The signal peptide has been tentatively identified as extending from about amino acid position 1 to about amino acid position 31 in the sequence of FIG. 49 (SEQ ID NO:95).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 32 to about 115, inclusive of FIG. 49 (SEQ ID NO:95), or (b) the complement of the DNA of (a).

Another embodiment is directed to fragments of a PRO537 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 48 (SEQ ID NO:94).

In another embodiment, the invention provides isolated PRO537 polypeptide encoded by any of the isolated nucleic acid sequences hereinabove identified.

In a specific aspect, the invention provides isolated native sequence PRO537 polypeptide, which in certain embodiments, includes an amino acid sequence comprising residues 1 or about 32 to about 115 of FIG. 49 (SEQ ID NO:95).

In another aspect, the invention concerns an isolated PRO537 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 32 to about 115, inclusive of FIG. 49 (SEQ ID NO:95).

In a further aspect, the invention concerns an isolated PRO537 polypeptide, comprising an amino acid sequence scoring at least about 80% positives, preferably at least about 85% positives, more preferably at least about 90% positives, most preferably at least about 95% positives when compared with the amino acid sequence of residues 1 or about 32 to about 115, inclusive of FIG. 49 (SEQ ID NO:95).

In yet another aspect, the invention concerns an isolated PRO537 polypeptide, comprising the sequence of amino acid residues 1 or about 32 to about 115, inclusive of FIG. 49 (SEQ ID NO:95), or a fragment thereof sufficient to provide a binding site for an anti-PRO537 antibody. Preferably, the PRO537 fragment retains a qualitative biological activity of a native PRO537 polypeptide.

In a still further aspect, the invention provides a polypeptide produced by (i) hybridizing a test DNA molecule under stringent conditions with (a) a DNA molecule encoding a PRO537 polypeptide having the sequence of amino acid residues from about 1 or about 32 to about 115, inclusive of FIG. 49 (SEQ ID NO:95), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

20. PRO536

A cDNA clone (DNA49142-1430) has been identified, that encodes a novel secreted polypeptide, designated in the present application as "PRO536".

In one embodiment, the invention provides an isolated nucleic acid molecule comprising DNA encoding a PRO536 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO536 polypeptide having the sequence of amino acid residues from about 1 or about 26 to about 313, inclusive of FIG. 51 (SEQ ID NO:97), or (b) the complement of the DNA molecule of (a).

In another aspect, the invention concerns an isolated nucleic acid molecule encoding a PRO536 polypeptide comprising DNA hybridizing to the complement of the nucleic acid between about nucleotides 48 or about 123 and about 986, inclusive, of FIG. 50 (SEQ ID NO:96). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203002 (DNA49142-1430) or (b) the complement of the nucleic acid molecule of (a). In a preferred embodiment, the nucleic acid comprises a DNA encoding the same mature polypeptide encoded by the human protein cDNA in ATCC Deposit No. 203002 (DNA49142-1430).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 313, inclusive of FIG. 51 (SEQ ID NO:97), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO536 polypeptide having the sequence of amino acid residues from 1 or about 26 to about 313, inclusive of FIG. 51 (SEQ ID NO:97), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO536 polypeptide, with or without the N-terminal signal sequence and/or the initiating methionine, or is complementary to such encoding nucleic acid molecule. The signal peptide has been tentatively identified as extending from about amino acid position 1 to about amino acid position 25 in the sequence of FIG. 51 (SEQ ID NO:97).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 313, inclusive of FIG. 51 (SEQ ID NO:97), or (b) the complement of the DNA of (a).

Another embodiment is directed to fragments of a PRO536 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 50 (SEQ ID NO:96).

In another embodiment, the invention provides isolated PRO536 polypeptide encoded by any of the isolated nucleic acid sequences hereinabove identified.

In a specific aspect, the invention provides isolated native sequence PRO536 polypeptide, which in certain embodiments, includes an amino acid sequence comprising residues 1 or about 26 to about 313 of FIG. 51 (SEQ ID NO:97).

In another aspect, the invention concerns an isolated PRO536 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 313, inclusive of FIG. 51 (SEQ ID NO:97).

In a further aspect, the invention concerns an isolated PRO536 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 313, inclusive of FIG. 51 (SEQ ID NO:97).

In yet another aspect, the invention concerns an isolated PRO536 polypeptide, comprising the sequence of amino acid residues 1 or about 26 to about 313, inclusive of FIG. 51 (SEQ ID NO:97), or a fragment thereof sufficient to provide a binding site for an anti-PRO536 antibody. Preferably, the PRO536 fragment retains a qualitative biological activity of a native PRO536 polypeptide.

In a still further aspect, the invention provides a polypeptide produced by (i) hybridizing a test DNA molecule under stringent conditions with (a) a DNA molecule encoding a PRO536 polypeptide having the sequence of amino acid residues from about 1 or about 26 to about 313, inclusive of FIG. 51 (SEQ ID NO:97), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

21. PRO535

A cDNA clone (DNA49143-1429) has been identified, having homology to nucleic acid encoding a putative peptidyl-prolyl isomerase that encodes a novel polypeptide, designated in the present application as "PRO535".

In one embodiment, the invention provides an isolated nucleic acid molecule comprising DNA encoding a PRO535 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO535 polypeptide having the sequence of amino acid residues from about 1 or about 26 to about 201, inclusive of FIG. 53 (SEQ ID NO:99), or (b) the complement of the DNA molecule of (a).

In another aspect, the invention concerns an isolated nucleic acid molecule encoding a PRO535 polypeptide comprising DNA hybridizing to the complement of the nucleic acid between about nucleotides 78 or about 153 and about 680, inclusive, of FIG. 52 (SEQ ID NO:98). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203013 (DNA49143-1429) or (b) the complement of the nucleic acid molecule of (a). In a preferred embodiment, the nucleic acid comprises a DNA encoding the same mature polypeptide encoded by the human protein cDNA in ATCC Deposit No. 203013 (DNA49143-1429).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 201, inclusive of FIG. 53 (SEQ ID NO:99), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO535 polypeptide having the sequence of amino acid residues from 1 or about 26 to about 201, inclusive of FIG. 53 (SEQ ID NO:99), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO535 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 25 in the sequence of FIG. 53 (SEQ ID NO:99). The transmembrane domain has been tentatively identified as extending from about amino acid position 155 to about amino acid position 174 in the PRO535 amino acid sequence (FIG. 53, SEQ ID NO:99).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 201, inclusive of FIG. 53 (SEQ ID NO:99), or (b) the complement of the DNA of (a).

Another embodiment is directed to fragments of a PRO535 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 52 (SEQ ID NO:98).

In another embodiment, the invention provides isolated PRO535 polypeptide encoded by any of the isolated nucleic acid sequences hereinabove identified.

In a specific aspect, the invention provides isolated native sequence PRO535 polypeptide, which in certain embodiments, includes an amino acid sequence comprising residues 1 or about 26 to about 201 of FIG. 53 (SEQ ID NO:99).

In another aspect, the invention concerns an isolated PRO535 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 201, inclusive of FIG. 53 (SEQ ID NO:99).

In a further aspect, the invention concerns an isolated PRO535 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 201, inclusive of FIG. 53 (SEQ ID NO:99).

In yet another aspect, the invention concerns an isolated PRO535 polypeptide, comprising the sequence of amino acid residues 1 or about 26 to about 201, inclusive of FIG. 53 (SEQ ID NO:99), or a fragment thereof sufficient to provide a binding site for an anti-PRO535 antibody. Preferably, the PRO535 fragment retains a qualitative biological activity of a native PRO535 polypeptide.

In a still further aspect, the invention provides a polypeptide produced by (i) hybridizing a test DNA molecule under stringent conditions with (a) a DNA molecule encoding a PRO535 polypeptide having the sequence of amino acid residues from about 1 or about 26 to about 201, inclusive of FIG. 53 (SEQ ID NO:99), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO535 polypeptide. In a particular embodiment, the agonist or antagonist is an anti-PRO535 antibody.

In a further embodiment, the invention concerns a method of identifying agonists or antagonists of a native PRO535 polypeptide by contacting the native PRO535 polypeptide with a candidate molecule and monitoring a biological activity mediated by said polypeptide.

In a still further embodiment, the invention concerns a composition comprising a PRO535 polypeptide, or an agonist or antagonist as hereinabove defined, in combination with a pharmaceutically acceptable carrier.

In another embodiment, the invention provides an expressed sequence tag (EST) designated herein as DNA30861 comprising the nucleotide sequence of FIG. 54 (SEQ ID NO:100).

In another embodiment, the invention provides an expressed sequence tag (EST) designated herein as DNA36351 comprising the nucleotide sequence of FIG. 55 (SEQ ID NO:101).

22. PRO718

Applicants have identified a cDNA clone that encodes a novel tetraspan membrane polypeptide, wherein the polypeptide is designated in the present application as "PRO718".

In one embodiment, the invention provides an isolated nucleic acid molecule comprising DNA encoding a PRO718 polypeptide. In one aspect, the isolated nucleic acid comprises DNA encoding the PRO718 polypeptide having amino acid residues 1 to 157 of FIG. 57 (SEQ ID NO:103), or is complementary to such encoding nucleic acid sequence, and remains stably bound to it under at least moderate, and optionally, under high stringency conditions. In other aspects, the isolated nucleic acid comprises DNA encoding the PRO718 polypeptide having amino acid residues X to 157 of FIG. 57 (SEQ ID NO:103), where X is any amino acid from 143 to 152 of FIG. 57 (SEQ ID NO:103), or is complementary to such encoding nucleic acid sequence, and remains stably bound to it under at least moderate, and optionally, under high stringency conditions. The isolated nucleic acid sequence may comprise the cDNA insert of the DNA49647-1398 vector deposited on Jun. 2, 1998 as ATCC 209919 which includes the nucleotide sequence encoding PRO718.

In another embodiment, the invention provides isolated PRO718 polypeptide. In particular, the invention provides isolated native sequence PRO718 polypeptide, which in one embodiment, includes an amino acid sequence comprising residues 1 to 157 of FIG. 57 (SEQ ID NO:103). Additional embodiments of the present invention are directed to isolated PRO718 polypeptides comprising amino acids X to 157 of FIG. 57 (SEQ ID NO:103), where X is any amino acid from 143 to 152 of FIG. 57 (SEQ ID NO:103). Optionally, the PRO718 polypeptide is obtained or is obtainable by expressing the polypeptide encoded by the cDNA insert of the DNA49647-1398 vector deposited on Jun. 2, 1998 as ATCC 209919.

In another embodiment, the invention provides an expressed sequence tag (EST) designated herein as DNA15386 which comprises the nucleotide sequence of FIG. 58 (SEQ ID NO:104).

In another embodiment, the invention provides an expressed sequence tag (EST) designated herein as DNA16630 which comprises the nucleotide sequence of FIG. 59 (SEQ ID NO:105).

In another embodiment, the invention provides an expressed sequence tag (EST) designated herein as DNA16829 which comprises the nucleotide sequence of FIG. 60 (SEQ ID NO:106).

In another embodiment, the invention provides an expressed sequence tag (EST) designated herein as DNA28357 which comprises the nucleotide sequence of FIG. 61 (SEQ ID NO:107).

In another embodiment, the invention provides an expressed sequence tag (EST) designated herein as DNA43512 which comprises the nucleotide sequence of FIG. 62 (SEQ ID NO:108).

23. PRO872

Applicants have identified a cDNA clone, DNA49819-1439, that encodes a novel polypeptide having homology to dehydrogenases wherein the polypeptide is designated in the present application as "PRO872".

In one embodiment, the invention provides an isolated nucleic acid molecule comprising DNA encoding a PRO872 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO872 polypeptide having the sequence of amino acid residues from 1 or about 19 to about 610, inclusive of FIG. 64 (SEQ ID NO:113), or (b) the complement of the DNA molecule of (a).

In another aspect, the invention concerns an isolated nucleic acid molecule encoding a PRO872 polypeptide comprising DNA that hybridizes to the complement of the nucleic acid between about residues 68 and about 1843, inclusive of FIG. 63 (SEQ ID NO:112). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209931 (DNA49819-1439), which was deposited on Jun. 2, 1998. In a preferred embodiment, the nucleic acid comprises a DNA molecule encoding the same mature polypeptide encoded by the human protein cDNA in ATCC Deposit No. 209931 (DNA49819-1439).

In a still further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 19 to about 610, inclusive of FIG. 64 (SEQ ID NO:113).

In a specific aspect, the invention provides an isolated nucleic acid molecule comprising DNA encoding a PRO872 extracellular domain (ECD), with or without the N-terminal signal sequence and/or the initiating methionine, and its soluble variants (i.e. transmembrane domain(s) deleted or inactivated) or is complementary to such encoding nucleic acid molecule. The signal peptide has been tentatively identified as extending from amino acid position 1 to about amino acid position 18 in the sequence of FIG. 64 (SEQ ID NO:113). The first transmembrane domain region has been tentatively identified as extending from about amino acid position 70 to about amino acid position 87 in the PRO872 amino acid sequence (FIG. 64, SEQ ID NO:113).

In another aspect, the invention concerns an isolated nucleic acid molecule comprising DNA encoding a polypeptide scoring at least about 80% positives, preferably at least about 90% positives, most preferably at least about 95% positives when compared with the amino acid sequence of residues 1 or about 19 to about 610, inclusive of FIG. 64 (SEQ ID NO:113).

Another embodiment is directed to fragments of a PRO872 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO872 polypeptide encoded by any of the isolated nucleic acid sequences hereinabove identified.

In a specific aspect, the invention provides isolated native sequence PRO872 polypeptide, which in one embodiment, includes an amino acid sequence comprising residues 1 or about 19 to 610 of FIG. 64 (SEQ ID NO:113).

In another aspect, the invention concerns an isolated PRO872 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to 610, inclusive of FIG. 64 (SEQ ID NO:113).

In a further aspect, the invention concerns an isolated PRO872 polypeptide, comprising an amino acid sequence scoring at least about 80% positives, preferably at least about 85% positives, more preferably at least about 90% positives, most preferably at least about 95% positives when compared with the amino acid sequence of residues 1 or about 19 to 610 of FIG. 64 (SEQ ID NO:113).

In another aspect, the invention concerns a PRO872 extracellular domain comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to X of FIG. 64 (SEQ ID NO:113), wherein X is any one of amino acid residues 66 to 75 of FIG. 64 (SEQ ID NO:113).

In yet another aspect, the invention concerns an isolated PRO872 polypeptide, comprising the sequence of amino acid residues 1 or about 19 to about 610, inclusive of FIG. 64 (SEQ ID NO:113), or a fragment thereof sufficient to provide a binding site for an anti-PRO872 antibody. Preferably, the PRO872 fragment retains a qualitative biological activity of a native PRO872 polypeptide.

In another aspect, the present invention is directed to fragments of a PRO872 polypeptide which are sufficiently long to provide an epitope against which an antibody may be generated.

In yet another embodiment, the invention concerns agonist and antagonists of the PRO872 polypeptide. In a particular embodiment, the agonist or antagonist is an anti-PRO872 antibody.

In a further embodiment, the invention concerns screening assays to identify agonists or antagonists of a native PRO872 polypeptide.

In still a further embodiment, the invention concerns a composition comprising a PRO872 polypeptide as hereinabove defined, in combination with a pharmaceutically acceptable carrier.

24. PRO1063

Applicants have identified a cDNA clone that encodes a novel polypeptide having homology to human type IV collagenase, wherein the polypeptide is designated in the present application as "PRO1063".

In one embodiment, the invention provides an isolated nucleic acid molecule comprising DNA encoding a PRO1063 polypeptide. In one aspect, the isolated nucleic acid comprises DNA encoding the PRO1063 polypeptide having amino acid residues 1 to 301 of FIG. 66 (SEQ ID NO:115), or is complementary to such encoding nucleic acid sequence, and remains stably bound to it under at least moderate, and optionally, under high stringency conditions. In other aspects, the isolated nucleic acid comprises DNA encoding the PRO1063 polypeptide having amino acid residues about 22 to 301 of FIG. 66 (SEQ ID NO:115), or is complementary to such encoding nucleic acid sequence, and remains stably bound to it under at least moderate, and optionally, under high stringency conditions. The isolated nucleic acid sequence may comprise the cDNA insert of the DNA49820-1427 vector deposited on Jun. 2, 1998 as ATCC 209932 which includes the nucleotide sequence encoding PRO1063.

In another embodiment, the invention provides isolated PRO1063 polypeptide. In particular, the invention provides isolated native sequence PRO1063 polypeptide, which in one embodiment, includes an amino acid sequence comprising residues 1 to 301 of FIG. 66 (SEQ ID NO:115). Additional embodiments of the present invention are directed to PRO1063 polypeptides comprising amino acids about 22 to 301 of FIG. 66 (SEQ ID NO:115). Optionally, the PRO1063 polypeptide is obtained or is obtainable by expressing the polypeptide encoded by the cDNA insert of the DNA49820-1427 vector deposited on Jun. 2, 1998 as ATCC 209932.

25. PRO619

A cDNA clone (DNA49821-1562) has been identified that encodes a novel polypeptide, designated in the present application as "PRO619." PRO619 polypeptides have sequence identity with VpreB genes, particularly to VpreB3.

In one embodiment, the invention provides an isolated nucleic acid molecule comprising DNA encoding a PRO619 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO619 polypeptide having the sequence of amino acid residues from about 1 or 21 to about 123, inclusive of FIG. 68 (SEQ ID NO:117), or (b) the complement of the DNA molecule of (a).

In another aspect, the invention concerns an isolated nucleic acid molecule encoding a PRO619 polypeptide comprising DNA hybridizing to the complement of the nucleic acid between about residues 81 or 141 and about 449, inclusive, of FIG. 67 (SEQ ID NO:116). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209981 (DNA49821-1562), or (b) the complement of the DNA molecule of (a). In a preferred embodiment, the nucleic acid comprises a DNA encoding the same mature polypeptide encoded by the human protein cDNA in ATCC Deposit No. 209981 (DNA49821-1562).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 21 to about 123, inclusive of FIG. 68 (SEQ ID NO:117), or the complement of the DNA of (a).

In a further aspect, the invention concerns an isolated nucleic acid molecule produced by hybridizing a test DNA molecule under stringent conditions with (a) a DNA molecule encoding a PRO619 polypeptide having the sequence of amino acid residues from about 1 or 21 to about 123, inclusive of FIG. 68 (SEQ ID NO:117), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO619 polypeptide, with or without the N-terminal signal sequence and/or the initiating methionine, which is in a soluble form. The signal peptide has been tentatively identified as extending from amino acid position 1 through about amino acid position 20 in the sequence of FIG. 68 (SEQ ID NO:117).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 21 to about 123, inclusive of FIG. 68 (SEQ ID NO:117), or (b) the complement of the DNA of (a).

Another embodiment is directed to fragments of a PRO619 polypeptide coding sequence that may find use as hybridization probes. Such nucleic acid fragments are from about 40 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO619 polypeptide encoded by any of the isolated nucleic acid sequences hereinabove defined.

In a specific aspect, the invention provides isolated native sequence PRO619 polypeptide, which in one embodiment, includes an amino acid sequence comprising residues 1 or 21 through 123 of FIG. 68 (SEQ ID NO:117).

In another aspect, the invention concerns an isolated PRO619 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 21 through about 123, inclusive of FIG. 68 (SEQ ID NO:117).

In a further aspect, the invention concerns an isolated PRO619 polypeptide, comprising an amino acid sequence scoring at least about 80% positives, preferably at least about 85% positives, more preferably at least about 90% positives, most preferably at least about 95% positives when compared with the amino acid sequence of residues 1 or 21 through 123 of FIG. 68 (SEQ ID NO:117).

In a still further aspect, the invention provides a polypeptide produced by (i) hybridizing a test DNA molecule under stringent conditions with (a) a DNA molecule encoding a PRO619 polypeptide having the sequence of amino acid residues from about 1 or 21 to about 123, inclusive of FIG. 68 (SEQ ID NO:117), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO619 polypeptide. In a particular embodiment, the agonist or antagonist is an anti-PRO619 antibody.

In a further embodiment, the invention concerns a method of identifying agonists or antagonists of a native PRO619 polypeptide, by contacting the native PRO619 polypeptide with a candidate molecule and monitoring a biological activity mediated by said polypeptide.

In a still further embodiment, the invention concerns a composition comprising a PRO619 polypeptide, or an agonist or antagonist as hereinabove defined, in combination with a pharmaceutically acceptable carrier.

26. PRO943

A cDNA clone (DNA52192-1369) has been identified, having homology to nucleic acid encoding fibroblast growth factor receptor-4 that encodes a novel polypeptide, designated in the present application as "PRO943".

In one embodiment, the invention provides an isolated nucleic acid molecule comprising DNA encoding a PRO943 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO943 polypeptide having the sequence of amino acid residues from about 1 or about 18 to about 504, inclusive of FIG. 70 (SEQ ID NO:119), or (b) the complement of the DNA molecule of (a).

In another aspect, the invention concerns an isolated nucleic acid molecule encoding a PRO943 polypeptide comprising DNA hybridizing to the complement of the nucleic acid between about nucleotides 150 or about 201 and about 1661, inclusive, of FIG. 69 (SEQ ID NO:118). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203042 (DNA52192-1369) or (b) the complement of the nucleic acid molecule of (a). In a preferred embodiment, the nucleic acid comprises a DNA encoding the same mature polypeptide encoded by the human protein cDNA in ATCC Deposit No. 203042 (DNA52192-1369).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 18 to about 504, inclusive of FIG. 70 (SEQ ID NO:119), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO943 polypeptide having the sequence of amino acid residues from 1 or about 18 to about 504, inclusive of FIG. 70 (SEQ ID NO:119), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO943 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 17 in the sequence of FIG. 70 (SEQ ID NO:119). The transmembrane domain has been tentatively identified as extending from about amino acid position 376 to about amino acid position 396 in the PRO943 amino acid sequence (FIG. 70, SEQ ID NO:119).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 18 to about 504, inclusive of FIG. 70 (SEQ ID NO:119), or (b) the complement of the DNA of (a).

Another embodiment is directed to fragments of a PRO943 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 69 (SEQ ID NO:118).

In another embodiment, the invention provides isolated PRO943 polypeptide encoded by any of the isolated nucleic acid sequences hereinabove identified.

In a specific aspect, the invention provides isolated native sequence PRO943 polypeptide, which in certain embodiments, includes an amino acid sequence comprising residues 1 or about 18 to about 504 of FIG. 70 (SEQ ID NO:119).

In another aspect, the invention concerns an isolated PRO943 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 18 to about 504, inclusive of FIG. 70 (SEQ ID NO:119).

In a further aspect, the invention concerns an isolated PRO943 polypeptide, comprising an amino acid sequence scoring at least about 80% positives, preferably at least about 85% positives, more preferably at least about 90% positives, most preferably at least about 95% positives when compared with the amino acid sequence of residues 1 or about 18 to about 504, inclusive of FIG. 70 (SEQ ID NO:119).

In yet another aspect, the invention concerns an isolated PRO943 polypeptide, comprising the sequence of amino acid residues 1 or about 18 to about 504, inclusive of FIG. 70 (SEQ ID NO:119), or a fragment thereof sufficient to provide a binding site for an anti-PRO943 antibody. Preferably, the PRO943 fragment retains a qualitative biological activity of a native PRO943 polypeptide.

In a still further aspect, the invention provides a polypeptide produced by (i) hybridizing a test DNA molecule under stringent conditions with (a) a DNA molecule encoding a PRO943 polypeptide having the sequence of amino acid residues from about 1 or about 18 to about 504, inclusive of FIG. 70 (SEQ ID NO:119), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO943 polypeptide. In a particular embodiment, the agonist or antagonist is an anti-PRO943 antibody.

In a further embodiment, the invention concerns a method of identifying agonists or antagonists of a native PRO943 polypeptide by contacting the native PRO943 polypeptide with a candidate molecule and monitoring a biological activity mediated by said polypeptide.

In a still further embodiment, the invention concerns a composition comprising a PRO943 polypeptide, or an agonist or antagonist as hereinabove defined, in combination with a pharmaceutically acceptable carrier.

27. PRO1188

A cDNA clone (DNA52598-1518) has been identified that encodes a novel polypeptide having homology to nucleotide pyrophosphohydrolase and designated in the present application as "PRO1188."

In one embodiment, the invention provides an isolated nucleic acid molecule comprising DNA encoding a PRO1188 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1188 polypeptide having the sequence of amino acid residues from about 22 to about 1184, inclusive of FIG. 72 (SEQ ID NO:124), or (b) the complement of the DNA molecule of (a).

In another aspect, the invention concerns an isolated nucleic acid molecule encoding a PRO1188 polypeptide comprising DNA hybridizing to the complement of the nucleic acid between about residues 199 and about 3687, inclusive, of FIG. 71 (SEQ ID NO:123). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203107 (DNA52598-1518), or (b) the complement of the DNA molecule of (a). In a preferred embodiment, the nucleic acid comprises a DNA encoding the same mature polypeptide encoded by the human protein cDNA in ATCC Deposit No. 203107 (DNA52598-1518).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 1184, inclusive of FIG. 72 (SEQ ID NO:124), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1188 polypeptide having the sequence of amino acid residues from about 22 to about 1184, inclusive of FIG. 72 (SEQ ID NO:124), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1188 polypeptide, with or without the N-terminal signal sequence and/or the initiating methionine, or is complementary to such encoding nucleic acid molecule. The signal peptide has been tentatively identified as extending from amino acid position 1 through about amino acid position 21 in the sequence of FIG. 72 (SEQ ID NO:124).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 1184, inclusive of FIG. 72 (SEQ ID NO:124), or (b) the complement of the DNA of (a).

In another embodiment, the invention provides isolated PRO1188 polypeptide encoded by any of the isolated nucleic acid sequences hereinabove defined.

In a specific aspect, the invention provides isolated native sequence PRO1188 polypeptide, which in one embodiment, includes an amino acid sequence comprising residues 22 to 1184 of FIG. 72 (SEQ ID NO:124).

In another aspect, the invention concerns an isolated PRO1188 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 1184, inclusive of FIG. 72 (SEQ ID NO:124).

In a further aspect, the invention concerns an isolated PRO1188 polypeptide, comprising an amino acid sequence scoring at least about 80% positives, preferably at least about 85% positives, more preferably at least about 90% positives, most preferably at least about 95% positives when compared with the amino acid sequence of residues 22 to 1184 of FIG. 72 (SEQ ID NO:124).

In a still further aspect, the invention provides a polypeptide produced by (i) hybridizing a test DNA molecule under stringent conditions with (a) a DNA molecule encoding a PRO1188 polypeptide having the sequence of amino acid residues from about 22 to about 1184, inclusive of FIG. 72 (SEQ ID NO:124), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1188 polypeptide. In a particular embodiment, the agonist or antagonist is an anti-PRO1188 antibody.

In a further embodiment, the invention concerns a method of identifying agonists or antagonists of a native PRO1188 polypeptide, by contacting the native PRO1188 polypeptide with a candidate molecule and monitoring a biological activity mediated by said polypeptide.

In a still further embodiment, the invention concerns a composition comprising a PRO1188 polypeptide, or an agonist or antagonist as hereinabove defined, in combination with a pharmaceutically acceptable carrier.

28. PRO1133

A cDNA clone (DNA53913-1490) has been identified that encodes a novel polypeptide having sequence identity with netrin-1a and designated in the present application as "PRO1133."

In one embodiment, the invention provides an isolated nucleic acid molecule comprising DNA encoding a PRO1133 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1133 polypeptide having the sequence of amino acid residues from about 19 to about 438, inclusive of FIG. 74 (SEQ ID NO:129), or (b) the complement of the DNA molecule of (a).

In another aspect, the invention concerns an isolated nucleic acid molecule encoding a PRO1133 polypeptide comprising DNA hybridizing to the complement of the nucleic acid between about residues 320 and about 1579, inclusive, of FIG. 73 (SEQ ID NO:128). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203162 (DNA53913-1490), or (b) the complement of the DNA molecule of (a). In a preferred embodiment, the nucleic acid comprises a DNA encoding the same mature polypeptide encoded by the human protein cDNA in ATCC Deposit No. 203162 (DNA53913-1490).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 438, inclusive of FIG. 74 (SEQ ID NO:129), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1133 polypeptide having the sequence of amino acid residues from about 19 to about 438, inclusive of FIG. 74 (SEQ ID NO:129), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 438, inclusive of FIG. 74 (SEQ ID NO:129), or (b) the complement of the DNA of (a).

Another embodiment is directed to fragments of a PRO1133 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1133 polypeptide encoded by any of the isolated nucleic acid sequences hereinabove defined.

In a specific aspect, the invention provides isolated native sequence PRO1133 polypeptide, which in one embodiment, includes an amino acid sequence comprising residues 19 through 438 of FIG. 74 (SEQ ID NO:129).

In another aspect, the invention concerns an isolated PRO1133 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 438, inclusive of FIG. 74 (SEQ ID NO:129).

In a further aspect, the invention concerns an isolated PRO1133 polypeptide, comprising an amino acid sequence scoring at least about 80% positives, preferably at least about 85% positives, more preferably at least about 90% positives, most preferably at least about 95% positives when compared with the amino acid sequence of residues 19 through 438 of FIG. 74 (SEQ ID NO:129).

In yet another aspect, the invention concerns an isolated PRO1133 polypeptide, comprising the sequence of amino acid residues 19 to about 438, inclusive of FIG. 74 (SEQ ID NO:129), or a fragment thereof sufficient to provide a binding site for an anti-PRO1133 antibody. Preferably, the PRO1133 fragment retains a qualitative biological activity of a native PRO1133 polypeptide.

In a still further aspect, the invention provides a polypeptide produced by (i) hybridizing a test DNA molecule under stringent conditions with (a) a DNA molecule encoding a PRO1133 polypeptide having the sequence of amino acid residues from about 19 to about 438, inclusive of FIG. 74 (SEQ ID NO:129), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1133 polypeptide. In a particular embodiment, the agonist or antagonist is an anti-PRO1133 antibody.

In a further embodiment, the invention concerns a method of identifying agonists or antagonists of a native PRO1133 polypeptide, by contacting the native PRO1133 polypeptide with a candidate molecule and monitoring a biological activity mediated by said polypeptide.

In a still further embodiment, the invention concerns a composition comprising a PRO1133 polypeptide, or an agonist or antagonist as hereinabove defined, in combination with a pharmaceutically acceptable carrier.

29. PRO784

A cDNA clone (DNA53978-1443) has been identified that encodes a novel polypeptide, designated in the present application as "PRO784".

In one embodiment, the invention provides an isolated nucleic acid molecule comprising DNA encoding a PRO784 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO784 polypeptide having the sequence of amino acid residues from about 16 to about 228, inclusive of FIG. 76 (SEQ ID NO:135), or (b) the complement of the DNA molecule of (a).

In another aspect, the invention concerns an isolated nucleic acid molecule encoding a PRO784 polypeptide comprising DNA hybridizing to the complement of the nucleic acid between about residues 182 and about 820, inclusive, of FIG. 75 (SEQ ID NO:134). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209983 (DNA53978-1443), or (b) the complement of the DNA molecule of (a). In a preferred embodiment, the nucleic acid comprises a DNA encoding the same mature polypeptide encoded by the human protein cDNA in ATCC Deposit No. 209983 (DNA53978-1443).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 228, inclusive of FIG. 76 (SEQ ID NO:135), or the complement of the DNA of (a).

In a further aspect, the invention concerns an isolated nucleic acid molecule having at least 50, and preferably at least 100 nucleotides and produced by hybridizing a test DNA molecule under stringent conditions with (a) a DNA molecule encoding a PRO784 polypeptide having the sequence of amino acid residues from about 16 to about 228, inclusive of FIG. 76 (SEQ ID NO:135), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO784 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position about 1 to about amino acid position 15 in the sequence of FIG. 76 (SEQ ID NO:135). The first transmembrane domain has been tentatively identified as extending from about amino acid position 68 to about amino acid position 87 in the PRO784 amino acid sequence (FIG. 76, SEQ ID NO:135).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 228, inclusive of FIG. 76 (SEQ ID NO:135), or (b) the complement of the DNA of (a).

In another aspect, the invention concerns hybridization probes that comprise fragments of the PRO784 coding sequence, or complementary sequence thereof. The hybridization probes preferably have at least about 20 nucleotides to about 80 nucleotides, and more preferably, at least about 40 to about 80 nucleotides.

In another embodiment, the invention provides isolated PRO784 polypeptide encoded by any of the isolated nucleic acid sequences hereinabove defined.

In a specific aspect, the invention provides isolated native sequence PRO784 polypeptide, which in one embodiment, includes an amino acid sequence comprising residues 16 to 228 of FIG. 76 (SEQ ID NO:135).

In another aspect, the invention concerns an isolated PRO784 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 228, inclusive of FIG. 76 (SEQ ID NO:135).

In a further aspect, the invention concerns an isolated PRO784 polypeptide, comprising an amino acid sequence scoring at least about 80% positives, preferably at least about 85% positives, more preferably at least about 90% positives, most preferably at least about 95% positives when compared with the amino acid sequence of residues 16 to 228 of FIG. 76 (SEQ ID NO:135).

In yet another aspect, the invention concerns an isolated PRO784 polypeptide, comprising the sequence of amino acid residues 16 to about 228, inclusive of FIG. 76 (SEQ ID NO:135), or a fragment thereof sufficient to provide a binding site for an anti-PRO784 antibody. Preferably, the PRO784 fragment retains a qualitative biological activity of a native PRO784 polypeptide.

In a still further aspect, the invention provides a polypeptide produced by (i) hybridizing a test DNA molecule under stringent conditions with (a) a DNA molecule encoding a PRO784 polypeptide having the sequence of amino acid residues from about 16 to about 228, inclusive of FIG. 76 (SEQ ID NO:135), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO784 polypeptide. In a particular embodiment, the agonist or antagonist is an anti-PRO784 antibody.

In a further embodiment, the invention concerns a method of identifying agonists or antagonists of a native PRO784 polypeptide, by contacting the native PRO784 polypeptide with a candidate molecule and monitoring a biological activity mediated by said polypeptide.

In a still further embodiment, the invention concerns a composition comprising a PRO784 polypeptide, or an agonist or antagonist as hereinabove defined, in combination with a pharmaceutically acceptable carrier.

30. PRO783

Applicants have identified a cDNA clone that encodes a novel multi-span transmembrane polypeptide, wherein the polypeptide is designated in the present application as "PRO783".

In one embodiment, the invention provides an isolated nucleic acid molecule comprising DNA encoding a PRO783 polypeptide. In one aspect, the isolated nucleic acid comprises DNA encoding the PRO783 polypeptide having amino acid residues 1 to 489 of FIG. 79 (SEQ ID NO:138), or is complementary to such encoding nucleic acid sequence, and remains stably bound to it under at least moderate, and optionally, under high stringency conditions. In other aspects, the isolated nucleic acid comprises DNA encoding the PRO783 polypeptide having amino acid residues 1 to X of FIG. 79 (SEQ ID NO:138), where X is any amino acid from 19 to 28 of FIG. 79 (SEQ ID NO:138), or is complementary to such encoding nucleic acid sequence, and remains stably bound to it under at least moderate, and optionally, under high stringency conditions. The isolated nucleic acid sequence may comprise the cDNA insert of the DNA53996-1442 vector deposited on Jun. 2, 1998 as ATCC 209921 which includes the nucleotide sequence encoding PRO783.

In another embodiment, the invention provides isolated PRO783 polypeptide. In particular, the invention provides isolated native sequence PRO783 polypeptide, which in one embodiment, includes an amino acid sequence comprising residues 1 to 489 of FIG. 79 (SEQ ID NO:138). Additional embodiments of the present invention are directed to PRO783 polypeptides comprising amino acid 1 to about X of FIG. 79 (SEQ ID NO:138), where X is any amino acid from 19 to 28 of FIG. 79 (SEQ ID NO:138). Optionally, the PRO783 polypeptide is obtained or is obtainable by expressing the polypeptide encoded by the cDNA insert of the DNA53996-1442 vector deposited on Jun. 2, 1998, as ATCC 209921.

In another embodiment, the invention provides an expressed sequence tag (EST) designated herein as DNA45201 which comprises the nucleic acid sequence shown in FIG. 80 (SEQ ID NO:139).

In another embodiment, the invention provides an expressed sequence tag (EST) designated herein as DNA14575 which comprises the nucleic acid sequence shown in FIG. 81 (SEQ ID NO:140).

31. PRO820

A cDNA clone (DNA56041-1416) has been identified, having sequence identity with immunoglobulin gamma Fe receptors that encodes a novel polypeptide, designated in the present application as "PRO820".

In one embodiment, the invention provides an isolated nucleic acid molecule comprising DNA encoding a PRO820 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO820 polypeptide having the sequence of amino acid residues from about 1 or 16 to about 124, inclusive of FIG. 83 (SEQ ID NO:146), or (b) the complement of the DNA molecule of (a). The term "or" as used herein to refer to amino or nucleic acids is meant to refer to two alternative embodiments provided herein, i.e., 1–124, or in another embodiment, 16–124.

In another aspect, the invention concerns an isolated nucleic acid molecule encoding a PRO820 polypeptide comprising DNA hybridizing to the complement of the nucleic acid between about residues 115 or 160 and about 486, inclusive, of FIG. 82 (SEQ ID NO:145). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203021 (DNA56041-1416), or (b) the complement of the DNA molecule of (a). In a preferred embodiment, the nucleic acid comprises a DNA encoding the same mature polypeptide encoded by the human protein cDNA in ATCC Deposit No. (DNA56041-1416).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 16 to about 124, inclusive of FIG. 83 (SEQ ID NO:146), or the complement of the DNA of (a).

In a further aspect, the invention concerns an isolated nucleic acid molecule produced by hybridizing a test DNA molecule under stringent conditions with (a) a DNA molecule encoding a PRO820 polypeptide having the sequence of amino acid residues from about 1 or 16 to about 124, inclusive of FIG. 83 (SEQ ID NO:146), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 16 to about 124, inclusive of FIG. 83 (SEQ ID NO:146), or (b) the complement of the DNA of (a).

In another embodiment, the invention provides isolated PRO820 polypeptide encoded by any of the isolated nucleic acid sequences hereinabove defined.

In a specific aspect, the invention provides isolated native sequence PRO820 polypeptide, which in one embodiment, includes an amino acid sequence comprising residues 1 or 16 through 124 of FIG. 83 (SEQ ID NO:146).

In another aspect, the invention concerns an isolated PRO820 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 16 to about 124, inclusive of FIG. 83 (SEQ ID NO:146).

In a further aspect, the invention concerns an isolated PRO820 polypeptide, comprising an amino acid sequence scoring at least about 80% positives, preferably at least about 85% positives, more preferably at least about 90% positives, most preferably at least about 95% positives when compared with the amino acid sequence of residues 1 or 16 through 124 of FIG. 83 (SEQ ID NO:146).

In a still further aspect, the invention provides a polypeptide produced by (i) hybridizing a test DNA molecule under stringent conditions with (a) a DNA molecule encoding a PRO820 polypeptide having the sequence of amino acid residues from about 1 or 16 to about 124, inclusive of FIG. 83 (SEQ ID NO:146), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO820 polypeptide. In a particular embodiment, the agonist or antagonist is an anti-PRO820 antibody.

In a further embodiment, the invention concerns a method of identifying agonists or antagonists of a native PRO820 polypeptide, by contacting the native PRO820 polypeptide with a candidate molecule and monitoring a biological activity mediated by said polypeptide.

In a still further embodiment, the invention concerns a composition comprising a PRO820 polypeptide, or an agonist or antagonist as hereinabove defined, in combination with a pharmaceutically acceptable carrier.

32. PRO1080

A cDNA clone (DNA56047-1456) has been identified that encodes a novel polypeptide, designated in the present application as "PRO1080." PRO1080 polypeptides have sequence identity with DnaJ proteins.

In one embodiment, the invention provides an isolated nucleic acid molecule comprising DNA encoding a PRO1080 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1080 polypeptide having the sequence of amino acid residues from about 1 or 23 to about 358, inclusive of FIG. 85 (SEQ ID NO:148), or (b) the complement of the DNA molecule of (a). The term "or" as used herein to refer to amino or nucleic acids is meant to refer to two alternative embodiments provided herein, i.e., 1–358, or in another embodiment, 23–358.

In another aspect, the invention concerns an isolated nucleic acid molecule encoding a PRO1080 polypeptide comprising DNA hybridizing to the complement of the nucleic acid between about residues 159 or 225 and about 1232, inclusive, of FIG. 84 (SEQ ID NO:147). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209948 (DNA56047-1456), or (b) the complement of the DNA molecule of (a). In a preferred embodiment, the nucleic acid comprises a DNA encoding the same mature polypeptide encoded by the human protein cDNA in ATCC Deposit No. 209948 (DNA56047-1456).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 23 to about 358, inclusive of FIG. 85 (SEQ ID NO:148), or the complement of the DNA of (a).

In a further aspect, the invention concerns an isolated nucleic acid molecule produced by hybridizing a test DNA molecule under stringent conditions with (a) a DNA molecule encoding a PRO1080 polypeptide having the sequence of amino acid residues from about 1 or 23 to about 358, inclusive of FIG. 85 (SEQ ID NO:148), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1080 polypeptide, with or without the N-terminal signal sequence and/or the initiating methionine. The signal peptide has been tentatively identified as extending from amino acid position 1 through about amino acid position 22 in the sequence of FIG. 85 (SEQ ID NO:148).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 23 to about 358, inclusive of FIG. 85 (SEQ ID NO:148), or (b) the complement of the DNA of (a).

In another embodiment, the invention provides isolated PRO1080 polypeptide encoded by any of the isolated nucleic acid sequences hereinabove defined.

In a specific aspect, the invention provides isolated native sequence PRO1080 polypeptide, which in one embodiment, includes an amino acid sequence comprising residues 1 or 23 through 358 of FIG. 85 (SEQ ID NO:148).

In another aspect, the invention concerns an isolated PRO1080 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 23 to about 358, inclusive of FIG. 85 (SEQ ID NO:148).

In a further aspect, the invention concerns an isolated PRO1080 polypeptide, comprising an amino acid sequence scoring at least about 80% positives, preferably at least about 85% positives, more preferably at least about 90% positives, most preferably at least about 95% positives when compared with the amino acid sequence of residues 1 or 23 through 358 of FIG. 85 (SEQ ID NO:148).

In a still further aspect, the invention provides a polypeptide produced by (i) hybridizing a test DNA molecule under stringent conditions with (a) a DNA molecule encoding a PRO1080 polypeptide having the sequence of amino acid residues from about 1 or 23 to about 358, inclusive of FIG. 85 (SEQ ID NO:148), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1080 polypeptide. In a particular embodiment, the agonist or antagonist is an anti-PRO1080 antibody.

In a further embodiment, the invention concerns a method of identifying agonists or antagonists of a native PRO1080 polypeptide, by contacting the native PRO1080 polypeptide with a candidate molecule and monitoring a biological activity mediated by said polypeptide.

In a still further embodiment, the invention concerns a composition comprising a PRO1080 polypeptide, or an agonist or antagonist as hereinabove defined, in combination with a pharmaceutically acceptable carrier.

In another embodiment, the invention provides an expressed sequence tag (EST) designated herein as DNA36527 comprising the nucleotide sequence of FIG. 86 (SEQ ID NO:149).

33. PRO1079

A cDNA clone (DNA56050-1455) has been identified that encodes a novel polypeptide, designated in the present application as "PRO1079".

In one embodiment, the invention provides an isolated nucleic acid molecule comprising DNA encoding a PRO1079 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1079 polypeptide having the sequence of amino acid residues from about 30 to about 226, inclusive of FIG. 88 (SEQ ID NO:151), or (b) the complement of the DNA molecule of (a).

In another aspect, the invention concerns an isolated nucleic acid molecule encoding a PRO1079 polypeptide comprising DNA hybridizing to the complement of the nucleic acid between about residues 270 and about 860, inclusive, of FIG. 87 (SEQ ID NO:150). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203011 (DNA56050-1455), or (b) the complement of the DNA molecule of (a). In a preferred embodiment, the nucleic acid comprises a DNA encoding the same mature polypeptide encoded by the human protein cDNA in ATCC Deposit No. 203011 (DNA56050-1455).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 30 to about 226, inclusive of FIG. 88 (SEQ ID NO:151), or the complement of the DNA of (a).

In a further aspect, the invention concerns an isolated nucleic acid molecule having at least about 50 nucleotides and preferably at least about 100 nucleotides, and produced by hybridizing a test DNA molecule under stringent conditions with (a) a DNA molecule encoding a PRO1079 polypeptide having the sequence of amino acid residues from about 30 to about 226, inclusive of FIG. 88 (SEQ ID NO:151), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1079 polypeptide, with or without the N-terminal signal sequence and/or the initiating methionine. The signal peptide has been tentatively identified as extending from amino acid position 1 through about amino acid position 29 in the sequence of FIG. 88 (SEQ ID NO:151).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 30 to about 226, inclusive of FIG. 88 (SEQ ID NO:151), or (b) the complement of the DNA of (a).

Another embodiment is directed to fragments of a PRO1079 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1079 polypeptide encoded by any of the isolated nucleic acid sequences hereinabove defined.

In a specific aspect, the invention provides isolated native sequence PRO1079 polypeptide, which in one embodiment, includes an amino acid sequence comprising residues 30 to 226 of FIG. 88 (SEQ ID NO:151).

In another aspect, the invention concerns an isolated PRO1079 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 30 to about 226, inclusive of FIG. 88 (SEQ ID NO:151).

In a further aspect, the invention concerns an isolated PRO1079 polypeptide, comprising an amino acid sequence scoring at least about 80% positives, preferably at least about 85% positives, more preferably at least about 90% positives, most preferably at least about 95% positives when compared with the amino acid sequence of residues 30 to 226 of FIG. 88 (SEQ ID NO:151).

In yet another aspect, the invention concerns an isolated PRO1079 polypeptide, comprising the sequence of amino acid residues 30 to about 226, inclusive of FIG. 88 (SEQ ID NO:151), or a fragment thereof sufficient to provide a binding site for an anti-PRO1079 antibody. Preferably, the PRO1079 fragment retains a qualitative biological activity of a native PRO1079 polypeptide.

In a still further aspect, the invention provides a polypeptide produced by (i) hybridizing a test DNA molecule under stringent conditions with (a) a DNA molecule encoding a PRO1079 polypeptide having the sequence of amino acid residues from about 30 to about 226, inclusive of FIG. 88 (SEQ ID NO:151), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

34. PRO793

A cDNA clone (DNA56110-1437) has been identified that encodes a novel transmembrane polypeptide, designated in the present application as "PRO793".

In one embodiment, the invention provides an isolated nucleic acid molecule comprising DNA encoding a PRO793 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO793 polypeptide having the sequence of amino acid residues from about 1 to about 138, inclusive of FIG. 90 (SEQ ID NO:153), or (b) the complement of the DNA molecule of (a).

In another aspect, the invention concerns an isolated nucleic acid molecule encoding a PRO793 polypeptide comprising DNA hybridizing to the complement of the nucleic acid between about nucleotides 77 and about 490, inclusive, of FIG. 89 (SEQ ID NO:152). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203113 (DNA56110-1437) or (b) the complement of the nucleic acid molecule of (a). In a preferred embodiment, the nucleic acid comprises a DNA encoding the same mature polypeptide encoded by the human protein cDNA in ATCC Deposit No. 203113 (DNA56110-1437).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 138, inclusive of FIG. 90 (SEQ ID NO:153), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO793 polypeptide having the sequence of amino acid residues from 1 to about 138, inclusive of FIG. 90 (SEQ ID NO:153), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO793 polypeptide, with or without the initiating methionine, and its soluble, i.e., transmembrane domain deleted or inactivated variants, or is complementary to such encoding nucleic acid molecule. The transmembrane domains have been tentatively identified as extending from about amino acid position 12 to about amino acid position 30, from about amino acid position 33 to about amino acid position 52, from about amino acid position 69 to about amino acid position 89 and from about amino acid position 93 to about amino acid position 109 in the PRO793 amino acid sequence (FIG. 90, SEQ ID NO:153).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 138, inclusive of FIG. 90 (SEQ ID NO:153), or (b) the complement of the DNA of (a).

Another embodiment is directed to fragments of a PRO793 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 89 (SEQ ID NO:152).

In another embodiment, the invention provides isolated PRO793 polypeptide encoded by any of the isolated nucleic acid sequences hereinabove identified.

In a specific aspect, the invention provides isolated native sequence PRO793 polypeptide, which in certain embodiments, includes an amino acid sequence comprising residues 1 to about 138 of FIG. 90 (SEQ ID NO:153).

In another aspect, the invention concerns an isolated PRO793 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 138, inclusive of FIG. 90 (SEQ ID NO:153).

In a further aspect, the invention concerns an isolated PRO793 polypeptide, comprising an amino acid sequence scoring at least about 80% positives, preferably at least about 85% positives, more preferably at least about 90% positives, most preferably at least about 95% positives when compared with the amino acid sequence of residues 1 to about 138, inclusive of FIG. 90 (SEQ ID NO:153).

In yet another aspect, the invention concerns an isolated PRO793 polypeptide, comprising the sequence of amino acid residues 1 to about 138, inclusive of FIG. 90 (SEQ ID NO:153), or a fragment thereof sufficient to provide a binding site for an anti-PRO793 antibody. Preferably, the PRO793 fragment retains a qualitative biological activity of a native PRO793 polypeptide.

In a still further aspect, the invention provides a polypeptide produced by (i) hybridizing a test DNA molecule under stringent conditions with (a) a DNA molecule encoding a PRO793 polypeptide having the sequence of amino acid residues from about 1 to about 138, inclusive of FIG. 90 (SEQ ID NO:153), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides an expressed sequence tag (EST) designated herein as DNA50177 comprising the nucleotide sequence of FIG. 91 (SEQ ID NO:154).

35. PRO1016

A cDNA clone (DNA56113-1378) has been identified, having sequence identity with acyltransferases that encodes a novel polypeptide, designated in the present application as "PRO1016".

In one embodiment, the invention provides an isolated nucleic acid molecule comprising DNA encoding a PRO1016 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1016 polypeptide having the sequence of amino acid residues from about 1 or 19 to about 378, inclusive of FIG. 93 (SEQ ID NO:156), or (b) the complement of the DNA molecule of (a). The term "or" as used herein to refer to amino or nucleic acids is meant to refer to two alternative embodiments provided herein, i.e., 1–378, or in another embodiment, 19–378.

In another aspect, the invention concerns an isolated nucleic acid molecule encoding a PRO1016 polypeptide comprising DNA hybridizing to the complement of the nucleic acid between about residues 168 or 222 and about 1301, inclusive, of FIG. 92 (SEQ ID NO:155). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203049 (DNA56113-1378), or (b) the complement of the DNA molecule of (a). In a preferred embodiment, the nucleic acid comprises a DNA encoding the same mature polypeptide encoded by the human protein cDNA in ATCC Deposit No. 203049 (DNA56113-1378).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 19 to about 378, inclusive of FIG. 93 (SEQ ID NO:156), or the complement of the DNA of (a).

In a further aspect, the invention concerns an isolated nucleic acid molecule produced by hybridizing a test DNA molecule under stringent conditions with (a) a DNA molecule encoding a PRO1016 polypeptide having the sequence of amino acid residues from about 1 or 19 to about 378, inclusive of FIG. 93 (SEQ ID NO:156), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1016 polypeptide, with or without the N-terminal signal sequence and/or the initiating methionine, and its soluble, i.e. transmembrane domains deleted or inactivated variants, or is complementary to such encoding nucleic acid molecule. The signal peptide has been tentatively identified as extending from amino acid position 1 through about amino acid position 18 in the sequence of FIG. 93 (SEQ ID NO:156). The transmembrane domains have been tentatively identified as extending from about amino acid position 305 through about amino acid position 330 and from about amino acid position 332 through about amino acid position 352 in the PRO1016 amino acid sequence (FIG. 93, SEQ ID NO:156).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 19 to about 378, inclusive of FIG. 93 (SEQ ID NO:156), or (b) the complement of the DNA of (a).

In another embodiment, the invention provides isolated PRO1016 polypeptide encoded by any of the isolated nucleic acid sequences hereinabove defined.

In a specific aspect, the invention provides isolated native sequence PRO1016 polypeptide, which in one embodiment, includes an amino acid sequence comprising residues 1 or 19 through 378 of FIG. 93 (SEQ ID NO:156).

In another aspect, the invention concerns an isolated PRO1016 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 19 to about 378, inclusive of FIG. 93 (SEQ ID NO:156).

In a further aspect, the invention concerns an isolated PRO1016 polypeptide, comprising an amino acid sequence scoring at least about 80% positives, preferably at least about 85% positives, more preferably at least about 90% positives, most preferably at least about 95% positives when compared with the amino acid sequence of residues 1 or 19 through 378 of FIG. 93 (SEQ ID NO:156).

In a still further aspect, the invention provides a polypeptide produced by (i) hybridizing a test DNA molecule under stringent conditions with (a) a DNA molecule encoding a PRO1016 polypeptide having the sequence of amino acid residues from about 1 or 19 to about 378, inclusive of FIG. 93 (SEQ ID NO:156), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1016 polypeptide. In a particular embodiment, the agonist or antagonist is an anti-PRO1016 antibody.

In a further embodiment, the invention concerns a method of identifying agonists or antagonists of a native PRO1016 polypeptide, by contacting the native PRO1016 polypeptide with a candidate molecule and monitoring a biological activity mediated by said polypeptide.

In a still further embodiment, the invention concerns a composition comprising a PRO1016 polypeptide, or an agonist or antagonist as hereinabove defined, in combination with a pharmaceutically acceptable carrier.

36. PRO1013

Applicants have identified a cDNA clone that encodes a novel polypeptide having sequence identity with P120, wherein the polypeptide is designated in the present application as "PRO1013".

In one embodiment, the invention provides an isolated nucleic acid molecule comprising DNA encoding a PRO1013 polypeptide. In one aspect, the isolated nucleic acid comprises DNA encoding the PRO1013 polypeptide having amino acid residues 1 through 409 of FIG. 95 (SEQ ID NO:158), or is complementary to such encoding nucleic acid sequence, and remains stably bound to it under at least moderate, and optionally, under high stringency conditions. The isolated nucleic acid sequence may comprise the cDNA insert of the vector deposited on Jun. 2, 1998 with the ATCC as DNA56410-1414 which includes the nucleotide sequence encoding PRO1013.

In another embodiment, the invention provides isolated PRO1013 polypeptide. In particular, the invention provides isolated native sequence PRO1013 polypeptide, which in one embodiment, includes an amino acid sequence comprising residues 1 through 409 of FIG. 95 (SEQ ID NO:158). Optionally, the PRO1013 polypeptide is obtained or is obtainable by expressing the polypeptide encoded by the cDNA insert of the vector deposited on Jun. 2, 1998 with the ATCC as DNA56410-1414.

37. PRO937

Applicants have identified a cDNA clone that encodes a novel polypeptide having homology to glypican family proteins, wherein the polypeptide is designated in the present application as "PRO937".

In one embodiment, the invention provides an isolated nucleic acid molecule comprising DNA encoding a PRO937 polypeptide. In one aspect, the isolated nucleic acid comprises DNA encoding the PRO937 polypeptide having amino acid residues 1 to 556 of FIG. 97 (SEQ ID NO:160), or is complementary to such encoding nucleic acid sequence, and remains stably bound to it under at least moderate, and optionally, under high stringency conditions. In other aspects, the isolated nucleic acid comprises DNA encoding the PRO937 polypeptide having amino acid residues about 23 to 556 of FIG. 97 (SEQ ID NO:160), or is complementary to such encoding nucleic acid sequence, and remains stably bound to it under at least moderate, and optionally, under high stringency conditions. The isolated nucleic acid sequence may comprise the cDNA insert of the DNA56436-1448 vector deposited on May 27, 1998, as ATCC 209902 which includes the nucleotide sequence encoding PRO937.

In another embodiment, the invention provides isolated PRO937 polypeptide. In particular, the invention provides isolated native sequence PRO937 polypeptide, which in one embodiment, includes an amino acid sequence comprising residues 1 to 556 of FIG. 97 (SEQ ID NO:160). Additional embodiments of the present invention are directed to PRO937 polypeptides comprising amino acids about 23 to 556 of FIG. 97 (SEQ ID NO:160). Optionally, the PRO937 polypeptide is obtained or is obtainable by expressing the polypeptide encoded by the cDNA insert of the DNA56436-1448 vector deposited on May 27, 1998 as ATCC 209902.

38. PRO842

A cDNA clone (DNA56855-1447) has been identified that encodes a novel secreted polypeptide, designated in the present application as "PRO842."

In one embodiment, the invention provides an isolated nucleic acid molecule comprising DNA encoding a PRO842 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO842 polypeptide having the sequence of amino acid residues from about 23 to about 119, inclusive of FIG. 99 (SEQ ID NO:165), or (b) the complement of the DNA molecule of (a).

In another aspect, the invention concerns an isolated nucleic acid molecule encoding a PRO842 polypeptide comprising DNA hybridizing to the complement of the nucleic acid between about residues 219 and about 509, inclusive, of FIG. 98 (SEQ ID NO:164). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203004 (DNA56855-1447), or (b) the complement of the DNA molecule of (a). In a preferred embodiment, the nucleic acid comprises a DNA encoding the same mature polypeptide encoded by the human protein cDNA in ATCC Deposit No. 203004 (DNA56855-1447).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 23 to about 119, inclusive of FIG. 99 (SEQ ID NO:165), or the complement of the DNA of (a).

In a further aspect, the invention concerns an isolated nucleic acid molecule having at least about 50 nucleotides, and preferably at least about 100 nucleotides, and produced by hybridizing a test DNA molecule under stringent conditions with (a) a DNA molecule encoding a PRO842 polypeptide having the sequence of amino acid residues from about 23 to about 119, inclusive of FIG. 99 (SEQ ID NO:165), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO842 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 22 in the sequence of FIG. 99 (SEQ ID NO:165).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 23 to about 119, inclusive of FIG. 99 (SEQ ID NO:165), or (b) the complement of the DNA of (a).

Another embodiment is directed to fragments of a PRO842 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO842 polypeptide encoded by any of the isolated nucleic acid sequences hereinabove defined.

In a specific aspect, the invention provides isolated native sequence PRO842 polypeptide, which in one embodiment, includes an amino acid sequence comprising residues 23 to 119 of FIG. 99 (SEQ ID NO:165).

In another aspect, the invention concerns an isolated PRO842 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 23 to about 119, inclusive of FIG. 99 (SEQ ID NO:165).

In a further aspect, the invention concerns an isolated PRO842 polypeptide, comprising an amino acid sequence scoring at least about 80% positives, preferably at least about 85% positives, more preferably at least about 90% positives, most preferably at least about 95% positives when compared with the amino acid sequence of residues 23 to 119 of FIG. 99 (SEQ ID NO:165).

In yet another aspect, the invention concerns an isolated PRO842 polypeptide, comprising the sequence of amino acid residues 23 to about 119, inclusive of FIG. 99 (SEQ ID NO:165), or a fragment thereof sufficient to provide a binding site for an anti-PRO842 antibody. Preferably, the PRO842 fragment retains a qualitative biological activity of a native PRO842 polypeptide.

In a still further aspect, the invention provides a polypeptide produced by (i) hybridizing a test DNA molecule under stringent conditions with (a) a DNA molecule encoding a PRO842 polypeptide having the sequence of amino acid residues from about 23 to about 119, inclusive of FIG. 99 (SEQ ID NO:165), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

39. PRO839

A cDNA clone (DNA56859-1445) has been identified that encodes a novel polypeptide, designated in the present application as "PRO839."

In one embodiment, the invention provides an isolated nucleic acid molecule comprising DNA encoding a PRO839 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO839 polypeptide having the sequence of amino acid residues from about 24 to about 87, inclusive of FIG. 101 (SEQ ID NO:167), or (b) the complement of the DNA molecule of (a).

In another aspect, the invention concerns an isolated nucleic acid molecule encoding a PRO839 polypeptide comprising DNA hybridizing to the complement of the nucleic acid between about residues 71 and about 262, inclusive, of FIG. 100 (SEQ ID NO:166). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203019 (DNA56859-1445), or (b) the complement of the DNA molecule of (a). In a preferred embodiment, the nucleic acid comprises a DNA encoding the same mature polypeptide encoded by the human protein cDNA in ATCC Deposit No. 203019 (DNA56859-1445).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 24 to about 87, inclusive of FIG. 101 (SEQ ID NO:167), or the complement of the DNA of (a).

In a further aspect, the invention concerns an isolated nucleic acid molecule having at least 50 nucleotides, and preferably at least 100 nucleotides and produced by hybridizing a test DNA molecule under stringent conditions with (a) a DNA molecule encoding a PRO839 polypeptide having the sequence of amino acid residues from about 24 to about 87, inclusive of FIG. 101 (SEQ ID NO:167), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO839 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 23 in the sequence of FIG. 101 (SEQ ID NO:167).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 24 to about 87, inclusive of FIG. 101 (SEQ ID NO:167), or (b) the complement of the DNA of (a).

Another embodiment is directed to fragments of a PRO839 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO839 polypeptide encoded by any of the isolated nucleic acid sequences hereinabove defined.

In a specific aspect, the invention provides isolated native sequence PRO839 polypeptide, which in one embodiment, includes an amino acid sequence comprising residues 24 to 87 of FIG. 101 (SEQ ID NO:167).

In another aspect, the invention concerns an isolated PRO839 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 24 to about 87, inclusive of FIG. 101 (SEQ ID NO:167).

In a further aspect, the invention concerns an isolated PRO839 polypeptide, comprising an amino acid sequence scoring at least about 80% positives, preferably at least about 85% positives, more preferably at least about 90% positives, most preferably at least about 95% positives when compared with the amino acid sequence of residues 24 to 87 of FIG. 101 (SEQ ID NO:167).

In yet another aspect, the invention concerns an isolated PRO839 polypeptide, comprising the sequence of amino acid residues 24 to about 87, inclusive of FIG. 101 (SEQ ID NO:167), or a fragment thereof sufficient to provide a binding site for an anti-PRO839 antibody. Preferably, the PRO839 fragment retains a qualitative biological activity of a native PRO839 polypeptide.

In a still further aspect, the invention provides a polypeptide produced by (i) hybridizing a test DNA molecule under stringent conditions with (a) a DNA molecule encoding a PRO839 polypeptide having the sequence of amino acid residues from about 24 to about 87, inclusive of FIG. 101 (SEQ ID NO:167), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

40. PRO1180

Applicants have identified a cDNA clone (DNA56860-1510) having homology to nucleic acid encoding methyltransferase enzymes that encodes a novel polypeptide, designated in the present application as "PRO1180".

In one embodiment, the invention provides an isolated nucleic acid molecule comprising DNA encoding a PRO1180 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1180 polypeptide having the sequence of amino acid residues from about 1 or about 24 to about 277, inclusive of FIG. 103 (SEQ ID NO:169), or (b) the complement of the DNA molecule of (a).

In another aspect, the invention concerns an isolated nucleic acid molecule encoding a PRO1180 polypeptide comprising DNA hybridizing to the complement of the nucleic acid between about nucleotides 78 or about 147 and about 908, inclusive of FIG. 102 (SEQ ID NO:168). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209952 (DNA56860-1510). In a preferred embodiment, the nucleic acid comprises a DNA encoding the same mature polypeptide encoded by the human protein cDNA in ATCC Deposit No. 209952 (DNA56860-1510).

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 24 to about 277, inclusive of FIG. 103 (SEQ ID NO:169).

In a specific aspect, the invention provides an isolated nucleic acid molecule comprising DNA encoding a PRO1180 polypeptide, with or without the N-terminal signal sequence and/or the initiating methionine, or is complementary to such encoding nucleic acid molecule. The signal peptide has been tentatively identified as extending from about amino acid position 1 to about amino acid position 23 in the sequence of FIG. 103 (SEQ ID NO:169).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 or about 24 to about 277, inclusive of FIG. 103 (SEQ ID NO:169).

Another embodiment is directed to fragments of a PRO1180 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1180 polypeptide encoded by any of the isolated nucleic acid sequences hereinabove identified.

In a specific aspect, the invention provides isolated native sequence PRO1180 polypeptide, which in one embodiment, includes an amino acid sequence comprising residues 1 or about 24 to about 277 of FIG. 103 (SEQ ID NO:169).

In another aspect, the invention concerns an isolated PRO1180 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 24 to about 277, inclusive of FIG. 103 (SEQ ID NO:169).

In a further aspect, the invention concerns an isolated PRO1180 polypeptide, comprising an amino acid sequence scoring at least about 80% positives, preferably at least about 85% positives, more preferably at least about 90% positives, most preferably at least about 95% positives when compared with the amino acid sequence of residues 1 or about 24 to about 277, inclusive of FIG. 103 (SEQ ID NO:169).

In yet another aspect, the invention concerns an isolated PRO1180 polypeptide, comprising the sequence of amino acid residues 1 or about 24 to about 277, inclusive of FIG. 103 (SEQ ID NO:169), or a fragment thereof sufficient to provide a binding site for an anti-PRO1180 antibody. Preferably, the PRO1180 fragment retains a qualitative biological activity of a native PRO1180 polypeptide.

In another aspect, the present invention is directed to fragments of a PRO1180 polypeptide which are sufficiently long to provide an epitope against which an antibody may be generated.

In yet another embodiment, the invention concerns agonists and antagonists of a native PRO1180 polypeptide. In a particular embodiment, the agonist or antagonist is an anti-PRO1180 antibody.

In a further embodiment, the invention concerns screening assays to identify agonists or antagonists of a native PRO1180 polypeptide.

In still a further embodiment, the invention concerns a composition comprising a PRO1180 polypeptide, or an agonist or antagonist as hereinabove defined, in combination with a pharmaceutically acceptable carrier.

41. PRO1134

A cDNA clone (DNA56865-1491) has been identified that encodes a novel secreted polypeptide, designated in the present application as "PRO1134".

In one embodiment, the invention provides an isolated nucleic acid molecule comprising DNA encoding a PRO1134 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1134 polypeptide having the sequence of amino acid residues from about 1 or about 24 to about 371, inclusive of FIG. 105 (SEQ ID NO:171), or (b) the complement of the DNA molecule of (a).

In another aspect, the invention concerns an isolated nucleic acid molecule encoding a PRO1134 polypeptide comprising DNA hybridizing to the complement of the nucleic acid between about nucleotides 153 or about 222 and about 1265, inclusive, of FIG. 104 (SEQ ID NO:170). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203022 (DNA56865-1491) or (b) the complement of the nucleic acid molecule of (a). In a preferred embodiment, the nucleic acid comprises a DNA encoding the same mature polypeptide encoded by the human protein cDNA in ATCC Deposit No. 203022 (DNA56865-1491).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 24 to about 371, inclusive of FIG. 105 (SEQ ID NO:171), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1134 polypeptide having the sequence of amino acid residues from 1 or about 24 to about 371, inclusive of FIG. 105 (SEQ ID NO:171), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1134 polypeptide, with or without the N-terminal signal sequence and/or the initiating methionine, or is complementary to such encoding nucleic acid molecule. The signal peptide has been tentatively identified as extending from about amino acid position 1 to about amino acid position 23 in the sequence of FIG. 105 (SEQ ID NO:171).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 24 to about 371, inclusive of FIG. 105 (SEQ ID NO:171), or (b) the complement of the DNA of (a).

Another embodiment is directed to fragments of a PRO1134 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 104 (SEQ ID NO:170).

In another embodiment, the invention provides isolated PRO1134 polypeptide encoded by any of the isolated nucleic acid sequences hereinabove identified.

In a specific aspect, the invention provides isolated native sequence PRO1134 polypeptide, which in certain embodiments, includes an amino acid sequence comprising residues 1 or about 24 to about 371 of FIG. 105 (SEQ ID NO:171).

In another aspect, the invention concerns an isolated PRO1134 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 24 to about 371, inclusive of FIG. 105 (SEQ ID NO:171).

In a further aspect, the invention concerns an isolated PRO1134 polypeptide, comprising an amino acid sequence scoring at least about 80% positives, preferably at least about 85% positives, more preferably at least about 90% positives, most preferably at least about 95% positives when compared with the amino acid sequence of residues 1 or about 24 to about 371, inclusive of FIG. 105 (SEQ ID NO:171).

In yet another aspect, the invention concerns an isolated PRO1134 polypeptide, comprising the sequence of amino acid residues 1 or about 24 to about 371, inclusive of FIG. 105 (SEQ ID NO:171), or a fragment thereof sufficient to provide a binding site for an anti-PRO1134 antibody. Preferably, the PRO1134 fragment retains a qualitative biological activity of a native PRO1134 polypeptide.

In a still further aspect, the invention provides a polypeptide produced by (i) hybridizing a test DNA molecule under stringent conditions with (a) a DNA molecule encoding a PRO1134 polypeptide having the sequence of amino acid residues from about 1 or about 24 to about 371, inclusive of FIG. 105 (SEQ ID NO:171), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides an expressed sequence tag (EST) designated herein as DNA52352 comprising the nucleotide sequence of SEQ ID NO:172 (see FIG. 106).

In another embodiment, the invention provides an expressed sequence tag (EST) designated herein as DNA55725 comprising the nucleotide sequence of SEQ ID NO:173 (see FIG. 107).

42. PRO830

A cDNA clone (DNA56866-1342) has been identified that encodes a novel secreted polypeptide, designated in the present application as "PRO830".

In one embodiment, the invention provides an isolated nucleic acid molecule comprising DNA encoding a PRO830 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO830 polypeptide having the sequence of amino acid residues from about 1 or about 34 to about 87, inclusive of FIG. 109 (SEQ ID NO:175), or (b) the complement of the DNA molecule of (a).

In another aspect, the invention concerns an isolated nucleic acid molecule encoding a PRO830 polypeptide comprising DNA hybridizing to the complement of the nucleic acid between about nucleotides 154 or about 253 and about 414, inclusive, of FIG. 108 (SEQ ID NO:174). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203023 (DNA56866-1342) or (b) the complement of the nucleic acid molecule of (a). In a preferred embodiment, the nucleic acid comprises a DNA encoding the same mature polypeptide encoded by the human protein cDNA in ATCC Deposit No. 203023 (DNA56866-1342).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 34 to about 87, inclusive of FIG. 109 (SEQ ID NO:175), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO830 polypeptide having the sequence of amino acid residues from 1 or about 34 to about 87, inclusive of FIG. 109 (SEQ ID NO:175), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO830 polypeptide, with or without the N-terminal signal sequence and/or the initiating methionine, or is complementary to such encoding nucleic acid molecule. The signal peptide has been tentatively identified as extending from about amino acid position 1 to about amino acid position 33 in the sequence of FIG. 109 (SEQ ID NO:175).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 34 to about 87, inclusive of FIG. 109 (SEQ ID NO:175), or (b) the complement of the DNA of (a).

Another embodiment is directed to fragments of a PRO830 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 108 (SEQ ID NO:174).

In another embodiment, the invention provides isolated PRO830 polypeptide encoded by any of the isolated nucleic acid sequences hereinabove identified.

In a specific aspect, the invention provides isolated native sequence PRO830 polypeptide, which in certain embodiments, includes an amino acid sequence comprising residues 1 or about 34 to about 87 of FIG. 109 (SEQ ID NO:175).

In another aspect, the invention concerns an isolated PRO830 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 34 to about 87, inclusive of FIG. 109 (SEQ ID NO:175).

In a further aspect, the invention concerns an isolated PRO830 polypeptide, comprising an amino acid sequence scoring at least about 80% positives, preferably at least about 85% positives, more preferably at least about 90% positives, most preferably at least about 95% positives when compared with the amino acid sequence of residues 1 or about 34 to about 87, inclusive of FIG. 109 (SEQ ID NO:175).

In yet another aspect, the invention concerns an isolated PRO830 polypeptide, comprising the sequence of amino acid residues 1 or about 34 to about 87, inclusive of FIG. 109 (SEQ ID NO:175), or a fragment thereof sufficient to provide a binding site for an anti-PRO830 antibody. Preferably, the PRO830 fragment retains a qualitative biological activity of a native PRO830 polypeptide.

In a still further aspect, the invention provides a polypeptide produced by (i) hybridizing a test DNA molecule under stringent conditions with (a) a DNA molecule encoding a PRO830 polypeptide having the sequence of amino acid residues from about 1 or about 34 to about 87, inclusive of FIG. 109 (SEQ ID NO:175), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

43. PRO1115

A cDNA clone (DNA56868-1478) has been identified that encodes a novel transmembrane polypeptide, designated in the present application as "PRO1115".

In one embodiment, the invention provides an isolated nucleic acid molecule comprising DNA encoding a PRO1115 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1115 polypeptide having the sequence of amino acid residues from about 21 to about 445, inclusive of FIG. 111 (SEQ ID NO:177), or (b) the complement of the DNA molecule of (a).

In another aspect, the invention concerns an isolated nucleic acid molecule encoding a PRO1115 polypeptide comprising DNA hybridizing to the complement of the nucleic acid between about residues 249 and about 1523, inclusive, of FIG. 110 (SEQ ID NO:176). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203024 (DNA56868-1478), or (b) the complement of the DNA molecule of (a). In a preferred embodiment, the nucleic acid comprises a DNA encoding the same mature polypeptide encoded by the human protein cDNA in ATCC Deposit No. 203024 (DNA56868-1478).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 445, inclusive of FIG. 111 (SEQ ID NO:177), or the complement of the DNA of (a).

In a further aspect, the invention concerns an isolated nucleic acid molecule having at least about 50 nucleotides and preferably at least about 100 nucleotides and produced by hybridizing a test DNA molecule under stringent conditions with (a) a DNA molecule encoding a PRO1115 polypeptide having the sequence of amino acid residues from about 21 to about 445, inclusive of FIG. 111 (SEQ ID NO:177), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1115 polypeptide, with or without the N-terminal signal sequence and/or the initiating methionine, and one or more of its transmembrane domains deleted or inactivated, or is complementary to such encoding nucleic acid molecule. The signal peptide has been tentatively identified as extending from amino acid position 1 through about amino acid position 20 in the sequence of FIG. 111 (SEQ ID NO:177). Transmembrane domains have been tentatively identified as extending from about amino acid positions 35–54, 75–97, 126–146, 185–204, 333–350, and 352–371 in the PRO1115 amino acid sequence (FIG. 111, SEQ ID NO:177).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 445, inclusive of FIG. 111 (SEQ ID NO:177), or (b) the complement of the DNA of (a).

Another embodiment is directed to fragments of a PRO1115 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO115 polypeptide encoded by any of the isolated nucleic acid sequences hereinabove defined.

In a specific aspect, the invention provides isolated native sequence PRO115 polypeptide, which in one embodiment, includes an amino acid sequence comprising residues 21 to 445 of FIG. 111 (SEQ ID NO:177).

In another aspect, the invention concerns an isolated PRO1115 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 445, inclusive of FIG. 111 (SEQ ID NO:177).

In a further aspect, the invention concerns an isolated PRO115 polypeptide, comprising an amino acid sequence scoring at least about 80% positives, preferably at least about 85% positives, more preferably at least about 90% positives, most preferably at least about 95% positives when compared with the amino acid sequence of residues 21 to 445 of FIG. 111 (SEQ ID NO:177).

In yet another aspect, the invention concerns an isolated PRO1115 polypeptide, comprising the sequence of amino acid residues 21 to about 445, inclusive of FIG. 111 (SEQ ID NO:177), or a fragment thereof sufficient to provide a binding site for an anti-PRO1115 antibody. Preferably, the PRO1115 fragment retains a qualitative biological activity of a native PRO1115 polypeptide.

In a still further aspect, the invention provides a polypeptide produced by (i) hybridizing a test DNA molecule under stringent conditions with (a) a DNA molecule encoding a PRO1115 polypeptide having the sequence of amino acid residues from about 21 to about 445, inclusive of FIG. 111 (SEQ ID NO:177), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

44. PRO1277

A cDNA clone (DNA56869-1545) has been identified that encodes a novel polypeptide having homology to Coch-5B2 and designated in the present application as "PRO1277."

In one embodiment, the invention provides an isolated nucleic acid molecule comprising DNA encoding a PRO1277 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1277 polypeptide having the sequence of amino acid residues from about 27 to about 678, inclusive of FIG. 113 (SEQ ID NO:179), or (b) the complement of the DNA molecule of (a).

In another aspect, the invention concerns an isolated nucleic acid molecule encoding a PRO1277 polypeptide comprising DNA hybridizing to the complement of the nucleic acid between about residues 266 and about 2221, inclusive, of FIG. 112 (SEQ ID NO:178). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203161 (DNA56869-1545), or (b) the complement of the DNA molecule of (a). In a preferred embodiment, the nucleic acid comprises a DNA encoding the same mature polypeptide encoded by the human protein cDNA in ATCC Deposit No. 203161 (DNA56869-1545).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 27 to about 678, inclusive of FIG. 113 (SEQ ID NO:179), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1277 polypeptide having the sequence of amino acid residues from about 27 to about 678, inclusive of FIG. 113 (SEQ ID NO:179), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1277 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 26 in the sequence of FIG. 113 (SEQ ID NO:179). The transmembrane domain has been tentatively identified as extending from about amino acid position 181 to about amino acid position 200 in the PRO1277 amino acid sequence (FIG. 113, SEQ ID NO:179).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 27 to about 678, inclusive of FIG. 113 (SEQ ID NO:179), or (b) the complement of the DNA of (a).

Another embodiment is directed to fragments of a PRO1277 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1277 polypeptide encoded by any of the isolated nucleic acid sequences hereinabove defined.

In a specific aspect, the invention provides isolated native sequence PRO1277 polypeptide, which in one embodiment, includes an amino acid sequence comprising residues 27 to 678 of FIG. 113 (SEQ ID NO:179).

In another aspect, the invention concerns an isolated PRO1277 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 27 to about 678, inclusive of FIG. 113 (SEQ ID NO:179).

In a further aspect, the invention concerns an isolated PRO1277 polypeptide, comprising an amino acid sequence scoring at least about 80% positives, preferably at least about 85% positives, more preferably at least about 90% positives, most preferably at least about 95% positives when compared with the amino acid sequence of residues 27 to 678 of FIG. 113 (SEQ ID NO:179).

In yet another aspect, the invention concerns an isolated PRO1277 polypeptide, comprising the sequence of amino acid residues 27 to about 678, inclusive of FIG. 113 (SEQ ID NO:179), or a fragment thereof sufficient to provide a binding site for an anti-PRO1277 antibody. Preferably, the PRO1277 fragment retains a qualitative biological activity of a native PRO1277 polypeptide.

In a still further aspect, the invention provides a polypeptide produced by (i) hybridizing a test DNA molecule under stringent conditions with (a) a DNA molecule encoding a PRO1277 polypeptide having the sequence of amino acid residues from about 27 to about 678, inclusive of FIG. 113 (SEQ ID NO:179), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1277 polypeptide. In a particular embodiment, the agonist or antagonist is an anti-PRO1277 antibody.

In a further embodiment, the invention concerns a method of identifying agonists or antagonists of a native PRO1277 polypeptide, by contacting the native PRO1277 polypeptide with a candidate molecule and monitoring a biological activity mediated by said polypeptide.

In a still further embodiment, the invention concerns a composition comprising a PRO1277 polypeptide, or an agonist or antagonist as hereinabove defined, in combination with a pharmaceutically acceptable carrier.

45. PRO1135

Applicants have identified a cDNA clone that encodes a novel polypeptide having homology to alpha 1,2-mannosidase, wherein the polypeptide is designated in the present application as "PRO1135".

In one embodiment, the invention provides an isolated nucleic acid molecule comprising DNA encoding a PRO1135 polypeptide. In one aspect, the isolated nucleic acid comprises DNA encoding the PRO1135 polypeptide having amino acid residues 1 to 541 of FIG. 115 (SEQ ID NO:181), or is complementary to such encoding nucleic acid sequence, and remains stably bound to it under at least moderate, and optionally, under high stringency conditions. In other aspects, the isolated nucleic acid comprises DNA encoding the PRO1135 polypeptide having amino acid residues about 22 to 541 of FIG. 115 (SEQ ID NO:181), or is complementary to such encoding nucleic acid sequence, and remains stably bound to it under at least moderate, and optionally, under high stringency conditions. The isolated nucleic acid sequence may comprise the cDNA insert of the DNA56870-1492 vector deposited on Jun. 2, 1998 as ATCC 209925 which includes the nucleotide sequence encoding PRO1135.

In another embodiment, the invention provides isolated PRO1135 polypeptide. In particular, the invention provides isolated native sequence PRO1135 polypeptide, which in one embodiment, includes an amino acid sequence comprising residues 1 to 541 of FIG. 115 (SEQ ID NO:181). Additional embodiments of the present invention are directed to PRO1135 polypeptides comprising amino acids about 22 to 541 of FIG. 115 (SEQ ID NO:181). Optionally, the PRO1135 polypeptide is obtained or is obtainable by expressing the polypeptide encoded by the cDNA insert of the DNA56870-1492 vector deposited on Jun. 2, 1998 as ATCC 209925.

46. PRO1114

A cDNA clone (DNA57033-1403) has been identified that encodes a novel interferon receptor polypeptide, designated in the present application as "PRO1114 interferon receptor".

In one embodiment, the invention provides an isolated nucleic acid molecule comprising DNA encoding a PRO1114 interferon receptor polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1114 interferon receptor polypeptide having the sequence of amino acid residues from about 1 or about 30 to about 311, inclusive of FIG. 117 (SEQ ID NO:183), or (b) the complement of the DNA molecule of (a).

In another aspect, the invention concerns an isolated nucleic acid molecule encoding a PRO1114 interferon receptor polypeptide comprising DNA hybridizing to the complement of the nucleic acid between about nucleotides 250 or about 337 and about 1182, inclusive, of FIG. 116 (SEQ ID NO:182). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209905 (DNA57033-1403) or (b) the complement of the nucleic acid molecule of (a). In a preferred embodiment, the nucleic acid comprises a DNA encoding the same mature polypeptide encoded by the human protein cDNA in ATCC Deposit No. 209905 (DNA57033-1403).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 30 to about 311, inclusive of FIG. 117 (SEQ ID NO:183), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1114 interferon receptor polypeptide having the sequence of amino acid residues from 1 or about 30 to about 311, inclusive of FIG. 117 (SEQ ID NO:183), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1114 interferon receptor polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 29 in the sequence of FIG. 117 (SEQ ID NO:183). The transmembrane domain has been tentatively identified as extending from about amino acid position 230 to about amino acid position 255 in the PRO1114 interferon receptor amino acid sequence (FIG. 117, SEQ ID NO:183).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 30 to about 311, inclusive of FIG. 117 (SEQ ID NO:183), or (b) the complement of the DNA of (a).

Another embodiment is directed to fragments of a PRO1114 interferon receptor polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 116 (SEQ ID NO:182).

In another embodiment, the invention provides isolated PRO1114 interferon receptor polypeptide encoded by any of the isolated nucleic acid sequences hereinabove identified.

In a specific aspect, the invention provides isolated native sequence PRO1114 interferon receptor polypeptide, which in certain embodiments, includes an amino acid sequence comprising residues 1 or about 30 to about 311 of FIG. 117 (SEQ ID NO:183).

In another aspect, the invention concerns an isolated PRO1114 interferon receptor polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 30 to about 311, inclusive of FIG. 117 (SEQ ID NO:183).

In a further aspect, the invention concerns an isolated PRO1114 interferon receptor polypeptide, comprising an amino acid sequence scoring at least about 80% positives, preferably at least about 85% positives, more preferably at least about 90% positives, most preferably at least about 95% positives when compared with the amino acid sequence of residues 1 or about 30 to about 311, inclusive of FIG. 117 (SEQ ID NO:183).

In yet another aspect, the invention concerns an isolated PRO1114 interferon receptor polypeptide, comprising the sequence of amino acid residues 1 or about 30 to about 311, inclusive of FIG. 117 (SEQ ID NO:183), or a fragment thereof sufficient to provide a binding site for an anti-PRO1114 interferon receptor antibody. Preferably, the PRO1114 interferon receptor fragment retains a qualitative biological activity of a native PRO1114 interferon receptor polypeptide.

In a still further aspect, the invention provides a polypeptide produced by (i) hybridizing a test DNA molecule under stringent conditions with (a) a DNA molecule encoding a PRO1114 interferon receptor polypeptide having the sequence of amino acid residues from about 1 or about 30 to about 311, inclusive of FIG. 117 (SEQ ID NO:183), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO114-interferon receptor polypeptide. In a particular embodiment, the agonist or antagonist is an anti-PRO1114 interferon receptor antibody.

In a further embodiment, the invention concerns a method of identifying agonists or antagonists of a native PRO1114 interferon receptor polypeptide by contacting the native PRO1114 interferon receptor polypeptide with a candidate molecule and monitoring a biological activity mediated by said polypeptide.

In a still further embodiment, the invention concerns a composition comprising a PRO1114 interferon receptor polypeptide, or an agonist or antagonist as hereinabove defined, in combination with a pharmaceutically acceptable carrier.

In another embodiment, the invention provides an expressed sequence tag (EST) designated herein as DNA48466 comprising the nucleotide sequence of SEQ ID NO:184 (see FIG. 118).

47. PRO828

Applicants have identified a cDNA clone that encodes a novel polypeptide having homology to glutathione peroxidases wherein the polypeptide is designated in the present application as "PRO828".

In one embodiment, the invention provides an isolated nucleic acid molecule comprising DNA encoding a PRO828 polypeptide. In one aspect, the isolated nucleic acid comprises DNA encoding the PRO828 polypeptide having amino acid residues 1 to 187 of FIG. 120 (SEQ ID NO:189), or is complementary to such encoding nucleic acid sequence, and remains stably bound to it under at least moderate, and optionally, under high stringency conditions. In other aspects, the isolated nucleic acid comprises DNA encoding the PRO828 polypeptide having amino acid residues about 22 to 187 of FIG. 120 (SEQ ID NO:189), or is complementary to such encoding nucleic acid sequence, and remains stably bound to it under at least moderate, and optionally, under high stringency conditions. The isolated nucleic acid sequence may comprise the cDNA insert of the DNA57037-1444 vector deposited on May 27, 1998 as ATCC 209903 which includes the nucleotide sequence encoding PRO828.

In another embodiment, the invention provides isolated PRO828 polypeptide. In particular, the invention provides isolated native sequence PRO828 polypeptide, which in one embodiment, includes an amino acid sequence comprising residues 1 to 187 of FIG. 120 (SEQ ID NO:189). Additional embodiments of the present invention are directed to PRO828 polypeptides comprising amino acids about 22 to 187 of FIG. 120 (SEQ ID NO:189). Optionally, the PRO828 polypeptide is obtained or is obtainable by expressing the polypeptide encoded by the cDNA insert of the DNA57037-1444 vector deposited on May 27, 1998 as ATCC 209903.

48. PRO1009

A cDNA clone (DNA57129-1413) has been identified, having sequence identity with a long chain acyl-CoA synthetase homologue, a long chain acyl-CoA synthetase and a long chain acyl-CoA synthetase ligase that encodes a novel polypeptide, designated in the present application as "PRO1009."

In one embodiment, the invention provides an isolated nucleic acid molecule comprising DNA encoding a PRO1009 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1009 polypeptide having the sequence of amino acid residues from about 1 or 23 to about 615, inclusive of FIG. 122 (SEQ ID NO:194), or (b) the complement of the DNA molecule of (a). The term "or" as used herein to refer to amino or nucleic acids is meant to refer to two separate alternative embodiments provided herein, i.e., 1–615 or 23–615.

In another aspect, the invention concerns an isolated nucleic acid molecule encoding a PRO1009 polypeptide comprising DNA hybridizing to the complement of the nucleic acid between about residues 41 or 107 and about 1885, inclusive, of FIG. 121 (SEQ ID NO:193). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209977 (DNA57129-1413), or (b) the complement of the DNA molecule of (a). In a preferred embodiment, the nucleic acid comprises a DNA encoding the same mature polypeptide encoded by the human protein cDNA in ATCC Deposit No. 209977 (DNA57129-1413).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 23 to about 615, inclusive of FIG. 122 (SEQ ID NO:194), or the complement of the DNA of (a).

In a further aspect, the invention concerns an isolated nucleic acid molecule produced by hybridizing a test DNA molecule under stringent conditions with (a) a DNA molecule encoding a PRO1009 polypeptide having the sequence of amino acid residues from about 1 or 23 to about 615, inclusive of FIG. 122 (SEQ ID NO:194), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1009 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 to about amino acid position 22 in the sequence of FIG. 122 (SEQ ID NO:194). The transmembrane domains have been tentatively identified as extending from about amino acid positions 140–161, 213–229 and 312–334 in the PRO1009 amino acid sequence (FIG. 122, SEQ ID NO:194).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 23 to about 615, inclusive of FIG. 122 (SEQ ID NO:194), or (b) the complement of the DNA of (a).

In another embodiment, the invention provides isolated PRO1009 polypeptide encoded by any of the isolated nucleic acid sequences hereinabove defined.

In a specific aspect, the invention provides isolated native sequence PRO1009 polypeptide, which in one embodiment, includes an amino acid sequence comprising residues 1 or 23 to 615 of FIG. 122 (SEQ ID NO:194).

In another aspect, the invention concerns an isolated PRO1009 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 23 to about 615, inclusive of FIG. 122 (SEQ ID NO:194).

In a further aspect, the invention concerns an isolated PRO1009 polypeptide, comprising an amino acid sequence scoring at least about 80% positives, preferably at least about 85% positives, more preferably at least about 90% positives, most preferably at least about 95% positives when compared with the amino acid sequence of residues 1 or 23 to 615 of FIG. 122 (SEQ ID NO:194).

In yet another aspect, the invention concerns an isolated PRO1009 polypeptide, comprising the sequence of amino acid residues 1 or 23 to about 615, inclusive of FIG. 122 (SEQ ID NO:194), or a fragment thereof sufficient to provide a binding site for an anti-PRO1009 antibody. Preferably, the PRO1009 fragment retains a qualitative biological activity of a native PRO1009 polypeptide.

In a still further aspect, the invention provides a polypeptide produced by (i) hybridizing a test DNA molecule under stringent conditions with (a) a DNA molecule encoding a PRO1009 polypeptide having the sequence of amino acid residues from about 1 or 23 through about 615, inclusive of FIG. 122 (SEQ ID NO:194), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1009 polypeptide. In a particular embodiment, the agonist or antagonist is an anti-PRO1009 antibody.

In a further embodiment, the invention concerns a method of identifying agonists or antagonists of a native PRO1009 polypeptide, by contacting the native PRO1009 polypeptide with a candidate molecule and monitoring a biological activity mediated by said polypeptide.

In a still further embodiment, the invention concerns a composition comprising a PRO1009 polypeptide, or an agonist or antagonist as hereinabove defined, in combination with a pharmaceutically acceptable carrier.

In another embodiment, the invention provides an expressed sequence tag (EST) designated herein as DNA50853 comprising the nucleotide sequence of FIG. 123 (SEQ ID NO:195).

49. PRO1007

Applicants have identified a cDNA clone that encodes a novel polypeptide having sequence identity with MAGPIAP, wherein the polypeptide is designated in the present application as "PRO1007".

In one embodiment, the invention provides an isolated nucleic acid molecule comprising DNA encoding a PRO1007 polypeptide. In one aspect, the isolated nucleic acid comprises DNA encoding the PRO1007 polypeptide having amino acid residues 1 through 346 of FIG. 125 (SEQ ID NO:197), or is complementary to such encoding nucleic acid sequence, and remains stably bound to it under at least moderate, and optionally, under high stringency conditions. The isolated nucleic acid sequence may comprise the cDNA insert of the vector deposited on Jun. 9, 1998 with the ATCC as DNA57690-1374 which includes the nucleotide sequence encoding PRO1007.

In another embodiment, the invention provides isolated PRO1007 polypeptide. In particular, the invention provides isolated native sequence PRO1007 polypeptide, which in one embodiment, includes an amino acid sequence comprising residues 1 through 346 of FIG. 125 (SEQ ID NO:197). An additional embodiment of the present invention is directed to an isolated extracellular domain of a PRO1007 polypeptide. Optionally, the PRO1007 polypeptide is obtained or is obtainable by expressing the polypeptide encoded by the cDNA insert of the vector deposited with the ATCC on Jun. 9, 1998 as DNA57690-1374.

50. PRO1056

A cDNA clone (DNA57693-1424) has been identified, having homology to nucleic acid encoding a chloride channel protein that encodes a novel polypeptide, designated in the present application as "PRO1056".

In one embodiment, the invention provides an isolated nucleic acid molecule comprising DNA encoding a PRO1056 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1056 polypeptide having the sequence of amino acid residues from about 1 or about 19 to about 120, inclusive of FIG. 127 (SEQ ID NO:199), or (b) the complement of the DNA molecule of (a).

In another aspect, the invention concerns an isolated nucleic acid molecule encoding a PRO1056 polypeptide comprising DNA hybridizing to the complement of the nucleic acid between about nucleotides 56 or about 110 and about 415, inclusive, of FIG. 126 (SEQ ID NO:198). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203008 (DNA57693-1424) or (b) the complement of the nucleic acid molecule of (a). In a preferred embodiment, the nucleic acid comprises a DNA encoding the same mature polypeptide encoded by the human protein cDNA in ATCC Deposit No. 203008 (DNA57693-1424).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 19 to about 120, inclusive of FIG. 127 (SEQ ID NO:199), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1056 polypeptide having the sequence of amino acid residues from 1 or about 19 to about 120, inclusive of FIG. 127 (SEQ ID NO:199), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1056 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 18 in the sequence of FIG. 127 (SEQ ID NO:199). The transmembrane domain has been tentatively identified as extending from about amino acid position 39 to about amino acid position 58 in the PRO1056 amino acid sequence (FIG. 127, SEQ ID NO:199).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 19 to about 120, inclusive of FIG. 127 (SEQ ID NO:199), or (b) the complement of the DNA of (a).

Another embodiment is directed to fragments of a PRO1056 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 126 (SEQ ID NO:198).

In another embodiment, the invention provides isolated PRO1056 polypeptide encoded by any of the isolated nucleic acid sequences hereinabove identified.

In a specific aspect, the invention provides isolated native sequence PRO1056 polypeptide, which in certain embodiments, includes an amino acid sequence comprising residues 1 or about 19 to about 120 of FIG. 127 (SEQ ID NO:199).

In another aspect, the invention concerns an isolated PRO1056 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to about 120, inclusive of FIG. 127 (SEQ ID NO:199).

In a further aspect, the invention concerns an isolated PRO1056 polypeptide, comprising an amino acid sequence scoring at least about 80% positives, preferably at least about 85% positives, more preferably at least about 90% positives, most preferably at least about 95% positives when compared with the amino acid sequence of residues 1 or about 19 to about 120, inclusive of FIG. 127 (SEQ ID NO:199).

In yet another aspect, the invention concerns an isolated PRO1056 polypeptide, comprising the sequence of amino acid residues 1 or about 19 to about 120, inclusive of FIG. 127 (SEQ ID NO:199), or a fragment thereof sufficient to provide a binding site for an anti-PRO1056 antibody. Preferably, the PRO1056 fragment retains a qualitative biological activity of a native PRO1056 polypeptide.

In a still further aspect, the invention provides a polypeptide produced by (i) hybridizing a test DNA molecule under stringent conditions with (a) a DNA molecule encoding a PRO1056 polypeptide having the sequence of amino acid residues from about 1 or about 19 to about 120, inclusive of FIG. 127 (SEQ ID NO:199), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1056 polypeptide. In a particular embodiment, the agonist or antagonist is an anti-PRO1056 antibody.

In a further embodiment, the invention concerns a method of identifying agonists or antagonists of a native PRO1056 polypeptide by contacting the native PRO1056 polypeptide with a candidate molecule and monitoring a biological activity mediated by said polypeptide.

In a still further embodiment, the invention concerns a composition comprising a PRO1056 polypeptide, or an agonist or antagonist as hereinabove defined, in combination with a pharmaceutically acceptable carrier.

51. PRO826

A cDNA clone (DNA57694-1341) has been identified that encodes a novel secreted polypeptide, designated in the present application as "PRO826".

In one embodiment, the invention provides an isolated nucleic acid molecule comprising DNA encoding a PRO826 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO826 polypeptide having the sequence of amino acid residues from about 1 or about 23 to about 99, inclusive of FIG. 129 (SEQ ID NO:201), or (b) the complement of the DNA molecule of (a).

In another aspect, the invention concerns an isolated nucleic acid molecule encoding a PRO826 polypeptide comprising DNA hybridizing to the complement of the nucleic acid between about nucleotides 13 or about 79 and about 309, inclusive, of FIG. 128 (SEQ ID NO:200). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203017 (DNA57694-1341) or (b) the complement of the nucleic acid molecule of (a). In a preferred embodiment, the nucleic acid comprises a DNA encoding the same mature polypeptide encoded by the human protein cDNA in ATCC Deposit No. 203017 (DNA57694-1341).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 23 to about 99, inclusive of FIG. 129 (SEQ ID NO:201), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO826 polypeptide having the sequence of amino acid residues from 1 or about 23 to about 99, inclusive of FIG. 129 (SEQ ID NO:201), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO826 polypeptide, with or without the N-terminal signal sequence and/or the initiating methionine, or is complementary to such encoding nucleic acid molecule. The signal peptide has been tentatively identified as extending from about amino acid position 1 to about amino acid position 22 in the sequence of FIG. 129 (SEQ ID NO:201).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 23 to about 99, inclusive of FIG. 129 (SEQ ID NO:201), or (b) the complement of the DNA of (a).

Another embodiment is directed to fragments of a PRO826 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 128 (SEQ ID NO:200).

In another embodiment, the invention provides isolated PRO826 polypeptide encoded by any of the isolated nucleic acid sequences hereinabove identified.

In a specific aspect, the invention provides isolated native sequence PRO826 polypeptide, which in certain embodiments, includes an amino acid sequence comprising residues 1 or about 23 to about 99 of FIG. 129 (SEQ ID NO:201).

In another aspect, the invention concerns an isolated PRO826 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 23 to about 99, inclusive of FIG. 129 (SEQ ID NO:201).

In a further aspect, the invention concerns an isolated PRO826 polypeptide, comprising an amino acid sequence scoring at least about 80% positives, preferably at least about 85% positives, more preferably at least about 90% positives, most preferably at least about 95% positives when compared with the amino acid sequence of residues 1 or about 23 to about 99, inclusive of FIG. 129 (SEQ ID NO:201).

In yet another aspect, the invention concerns an isolated PRO826 polypeptide, comprising the sequence of amino acid residues 1 or about 23 to about 99, inclusive of FIG. 129 (SEQ ID NO:201), or a fragment thereof sufficient to provide a binding site for an anti-PRO826 antibody. Preferably, the PRO826 fragment retains a qualitative biological activity of a native PRO826 polypeptide.

In a still further aspect, the invention provides a polypeptide produced by (i) hybridizing a test DNA molecule under stringent conditions with (a) a DNA molecule encoding a PRO826 polypeptide having the sequence of amino acid residues from about 1 or about 23 to about 99, inclusive of FIG. 129 (SEQ ID NO:201), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

52. PRO819

A cDNA clone (DNA57695-1340) has been identified that encodes a novel secreted polypeptide, designated in the present application as "PRO819".

In one embodiment, the invention provides an isolated nucleic acid molecule comprising DNA encoding a PRO819 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO819 polypeptide having the sequence of amino acid residues from about 1 or about 25 to about 52, inclusive of FIG. 131 (SEQ ID NO:203), or (b) the complement of the DNA molecule of (a).

In another aspect, the invention concerns an isolated nucleic acid molecule encoding a PRO819 polypeptide comprising DNA hybridizing to the complement of the nucleic acid between about nucleotides 46 or about 118 and about 201, inclusive, of FIG. 130 (SEQ ID NO:202). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203006 (DNA57695-1340) or (b) the complement of the nucleic acid molecule of (a). In a preferred embodiment, the nucleic acid comprises a DNA encoding the same mature polypeptide encoded by the human protein cDNA in ATCC Deposit No. 203006 (DNA57695-1340).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 52, inclusive of FIG. 131 (SEQ ID NO:203), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO819 polypeptide having the sequence of amino acid residues from 1 or about 25 to about 52, inclusive of FIG. 131 (SEQ ID NO:203), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO819 polypeptide, with or without the N-terminal signal sequence and/or the initiating methionine, or is complementary to such encoding nucleic acid molecule. The signal peptide has been tentatively identified as extending from about amino acid position 1 to about amino acid position 24 in the sequence of FIG. 131 (SEQ ID NO:203).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 25 to about 52, inclusive of FIG. 131 (SEQ ID NO:203), or (b) the complement of the DNA of (a).

Another embodiment is directed to fragments of a PRO819 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 130 (SEQ ID NO:202).

In another embodiment, the invention provides isolated PRO819 polypeptide encoded by any of the isolated nucleic acid sequences hereinabove identified.

In a specific aspect, the invention provides isolated native sequence PRO819 polypeptide, which in certain embodiments, includes an amino acid sequence comprising residues 1 or about 25 to about 52 of FIG. 131 (SEQ ID NO:203).

In another aspect, the invention concerns an isolated PRO819 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to about 52, inclusive of FIG. 131 (SEQ ID NO:203).

In a further aspect, the invention concerns an isolated PRO819 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 52, inclusive of FIG. 131 (SEQ ID NO:203).

In yet another aspect, the invention concerns an isolated PRO819 polypeptide, comprising the sequence of amino acid residues 1 or about 25 to about 52, inclusive of FIG. 131 (SEQ ID NO:203), or a fragment thereof sufficient to provide a binding site for an anti-PRO819 antibody. Preferably, the PRO819 fragment retains a qualitative biological activity of a native PRO819 polypeptide.

In a still further aspect, the invention provides a polypeptide produced by (i) hybridizing a test DNA molecule under stringent conditions with (a) a DNA molecule encoding a PRO819 polypeptide having the sequence of amino acid residues from about 1 or about 25 to about 52, inclusive of FIG. 131 (SEQ ID NO:203), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

53. PRO1006

A cDNA clone (DNA57699-1412) has been identified, having sequence identity with a virud protein believed to be a tyrosine protein kinase, that encodes a novel polypeptide, designated in the present application as "PRO1006."

In one embodiment, the invention provides an isolated nucleic acid molecule comprising DNA encoding a PRO1006 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1006 polypeptide having the sequence of amino acid residues from about 1 or 24 to about 392, inclusive of FIG. 133 (SEQ ID NO:205), or (b) the complement of the DNA molecule of (a). The term "or" as used herein to refer to amino or nucleic acids is meant to refer to two alternative embodiments provided herein, i.e., 1–392, or in another embodiment, 24–392.

In another aspect, the invention concerns an isolated nucleic acid molecule encoding a PRO1006 polypeptide comprising DNA hybridizing to the complement of the nucleic acid between about residues 28 or 97 and about 1203, inclusive, of FIG. 132 (SEQ ID NO:204). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203020 (DNA57699-1412), or (b) the complement of the DNA molecule of (a). In a preferred embodiment, the nucleic acid comprises a DNA encoding the same mature polypeptide encoded by the human protein cDNA in ATCC Deposit No. 203020 (DNA57699-1412).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 24 to about 392, inclusive of FIG. 133 (SEQ ID NO:205), or the complement of the DNA of (a).

In a further aspect, the invention concerns an isolated nucleic acid molecule produced by hybridizing a test DNA molecule under stringent conditions with (a) a DNA molecule encoding a PRO1006 polypeptide having the sequence of amino acid residues from about 1 or 24 to about 392, inclusive of FIG. 133 (SEQ ID NO:205), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 24 to about 392, inclusive of FIG. 133 (SEQ ID NO:205), or (b) the complement of the DNA of (a).

In another embodiment, the invention provides isolated PRO1006 polypeptide encoded by any of the isolated nucleic acid sequences hereinabove defined.

In a specific aspect, the invention provides isolated native sequence PRO1006 polypeptide, which in one embodiment, includes an amino acid sequence comprising residues 1 or 24 through 392 of FIG. 133 (SEQ ID NO:205).

In another aspect, the invention concerns an isolated PRO1006 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 24 to about 392, inclusive of FIG. 133 (SEQ ID NO:205).

In a further aspect, the invention concerns an isolated PRO1006 polypeptide, comprising an amino acid sequence scoring at least about 80% positives, preferably at least about 85% positives, more preferably at least about 90% positives, most preferably at least about 95% positives when compared with the amino acid sequence of residues 1 or 24 through 392 of FIG. 133 (SEQ ID NO:205).

In a still further aspect, the invention provides a polypeptide produced by (i) hybridizing a test DNA molecule under stringent conditions with (a) a DNA molecule encoding a PRO1006 polypeptide having the sequence of amino acid residues from about 1 or 24 to about 392, inclusive of FIG. 133 (SEQ ID NO:205), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1006 polypeptide. In a particular embodiment, the agonist or antagonist is an anti-PRO1006 antibody.

In a further embodiment, the invention concerns a method of identifying agonists or antagonists of a native PRO1006 polypeptide, by contacting the native PRO1006 polypeptide with a candidate molecule and monitoring a biological activity mediated by said polypeptide.

In a still further embodiment, the invention concerns a composition comprising a PRO1006 polypeptide, or an agonist or antagonist as hereinabove defined, in combination with a pharmaceutically acceptable carrier.

54. PRO1112

Applicants have identified a cDNA clone that encodes a novel polypeptide having multiple transmembrane domains and having some sequence identity with a *Mycobacterium tuberculosis* peptide, a peptide found in a Dayhoff database designated as "MTY20B11_13", wherein the novel polypeptide is designated in the present application as "PRO1112".

In one embodiment, the invention provides an isolated nucleic acid molecule comprising DNA encoding a PRO1112 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO112 polypeptide having the sequence of amino acid residues from 1 or about 14 through about 262 of FIG. 135 (SEQ ID NO:207), or (b) the complement of the DNA molecule of (a).

In another aspect, the invention concerns an isolated nucleic acid molecule encoding a PRO1112 polypeptide comprising DNA hybridizing to the complement of the nucleic acid between about residues about 20 or 59 through 809 of FIG. 134 (SEQ ID NO:206). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in the ATCC Deposit of DNA57702-1476 made on Jun. 9, 1998. In a preferred embodiment, the nucleic acid comprises a DNA encoding the same mature polypeptide encoded by the human protein cDNA in the ATCC Deposit of DNA57702-1476 made on Jun. 9, 1998.

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 14 through about 262 of FIG. 135 (SEQ ID NO:207).

In a specific aspect, the invention provides an isolated nucleic acid molecule comprising DNA encoding a PRO1112 polypeptide, with or without the N-terminal signal sequence and/or the initiating methionine, and its soluble, i.e., transmembrane domains deleted or inactivated variants, or is complementary to such encoding nucleic acid molecule. The signal peptide has been tentatively identified as extending from amino acid position 1 through about amino acid position 13 of FIG. 135 (SEQ ID NO:207). The transmembrane domains have been tentatively identified as extending from about amino acid positions 58–76, 99–113, 141–159 and 203–222 of FIG. 135 (SEQ ID NO:207).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 or about 14 through 262 of FIG. 135 (SEQ ID NO:207).

Another embodiment is directed to fragments of a PRO112 polypeptide coding sequence that may find use as hybridization probes. Such nucleic acid fragments are from about 60 to about 100 nucleotides in length.

In another embodiment, the invention provides isolated PRO112 polypeptide encoded by any of the isolated nucleic acid sequences hereinabove identified.

In a specific aspect, the invention provides isolated native sequence PRO112 polypeptide, which in one embodiment, includes an amino acid sequence comprising residues 1 or 14 through about 262 of FIG. 135 (SEQ ID NO:207).

In another aspect, the invention concerns an isolated PRO112 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 14 through about 262 of FIG. 135 (SEQ ID NO:207).

In a further aspect, the invention concerns an isolated PRO1112 polypeptide, comprising an amino acid sequence scoring at least about 80% positives, preferably at least about 85% positives, more preferably at least about 90% positives, most preferably at least about 95% positives when compared with the amino acid sequence of residues 1 or about 14 through about 262 of FIG. 135 (SEQ ID NO:207).

In yet another aspect, the invention concerns an isolated PRO112 polypeptide, comprising the sequence of amino acid residues 1 or about 14 through about 262 of FIG. 135 (SEQ ID NO:207), or a fragment thereof sufficient to provide a binding site for an anti-PRO1112 antibody. Preferably, the PRO1112 fragment retains a qualitative biological activity of a native PRO1112 polypeptide.

In another aspect, the present invention is directed to fragments of a PRO1112 polypeptide which are sufficiently long to provide an epitope against which an antibody may be generated.

55. PRO1074

Applicants have identified a cDNA clone, DNA57704-1452, that encodes a novel polypeptide having homology to galactosyltransferase, wherein the polypeptide is designated in the present application as "PRO1074".

In one embodiment, the invention provides an isolated nucleic acid molecule comprising DNA encoding a PRO1074 polypeptide.

In one aspect, the isolated nucleic acid comprises DNA having at least about 80% sequence identity, preferably at least about 85% sequence identity, more preferably at least about 90% sequence identity, and most preferably at least about 95% sequence identity to (a) a DNA molecule encoding a PRO1074 polypeptide having the sequence of amino acid residues from 1 to about 331, inclusive of FIG. 137 (SEQ ID NO:209), or (b) the complement of the DNA molecule of (a).

In another aspect, the invention concerns an isolated nucleic acid molecule encoding a PRO1074 polypeptide comprising DNA that hybridizes to the complement of the nucleic acid sequence having about residues 322 to 1314, inclusive of FIG. 136 (SEQ ID NO:208). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, and most preferably at least about 95% sequence identity to (a) a DNA molecule encoding the same mature polypeptide encoded by the human protein cDNA in ATCC Deposit No. 209953 (DNA57704-1452), which was deposited on Jun. 9, 1998, or (b) the complement of the DNA molecule of (a).

In a preferred embodiment, the nucleic acid comprises a DNA molecule encoding the same mature polypeptide encoded by the human protein cDNA in ATCC Deposit No. 209953 (DNA57704-1452).

In a still further aspect, the invention concerns an isolated nucleic acid molecule comprising DNA encoding a polypeptide having at least about 80% sequence identity, preferably at least about 85% sequence identity, more preferably at least about 90% sequence identity, and most preferably at least about 95% sequence identity to the sequence of amino acid residues 1 to about 331, inclusive of FIG. 137 (SEQ ID NO:209).

In a specific aspect, the invention provides an isolated nucleic acid molecule comprising DNA encoding a PRO1074 extracellular domain (ECD), with or without the initiating methionine, and its soluble variants (i.e. transmembrane domain(s) deleted or inactivated) or is complementary to such encoding nucleic acid molecule. A type II transmembrane domain region has been tentatively identified as extending from about amino acid position 20 to 39 in the PRO1074 amino acid sequence (FIG. 137, SEQ ID NO:209).

In another aspect, the invention concerns an isolated nucleic acid molecule comprising DNA encoding a polypeptide scoring at least about 80% positives, preferably at least about 90% positives, and most preferably at least about 95% positives when compared with the amino acid sequence of residues 1 to about 331, inclusive of FIG. 137 (SEQ ID NO:209).

Another embodiment is directed to fragments of a PRO1074 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1074 polypeptide encoded by any of the isolated nucleic acid sequences hereinabove identified.

In a specific aspect, the invention provides isolated native sequence PRO1074 polypeptide, which in one embodiment, includes an amino acid sequence comprising residues 1 to 331 of FIG. 137 (SEQ ID NO:209).

In another aspect, the invention concerns an isolated PRO1074 polypeptide, comprising an amino acid sequence having at least about 80% sequence identity, preferably at least about 85% sequence identity, more preferably at least about 90% sequence identity, and most preferably at least about 95% sequence identity to the sequence of amino acid residues 1 to 331, inclusive of FIG. 137 (SEQ ID NO:209).

In a further aspect, the invention concerns an isolated PRO1074 polypeptide, comprising an amino acid sequence scoring at least about 80% positives, preferably at least about 85% positives, more preferably at least about 90% positives, and most preferably at least about 95% positives when compared with the amino acid sequence of residues 1 to about 331 of FIG. 137 (SEQ ID NO:209).

In another aspect, the invention concerns a PRO1074 extracellular domain comprising an amino acid sequence having at least about 80% sequence identity, preferably at least about 85% sequence identity, more preferably at least about 90% sequence identity, and most preferably at least about 95% sequence identity to the sequence of amino acid residues X to 331 of FIG. 2 (SEQ ID NO:3), wherein X is any one of amino acid residues 35 to 44 of FIG. 137 (SEQ ID NO:209).

In yet another aspect, the invention concerns an isolated PRO1074 polypeptide, comprising the sequence of amino acid residues 1 to about 331, inclusive of FIG. 137 (SEQ ID NO:209), or a fragment thereof sufficient to provide a binding site for an anti-PRO1074 antibody. Preferably, the PRO1074 fragment retains a qualitative biological activity of a native PRO1074 polypeptide.

In another aspect, the present invention is directed to fragments of a PRO1074 polypeptide which are sufficiently long to provide an epitope against which an antibody may be generated.

In yet another embodiment, the invention concerns agonist and antagonists of the PRO1074 polypeptide. In a particular embodiment, the agonist or antagonist is an anti-PRO1074 antibody.

In a further embodiment, the invention concerns screening assays to identify agonists or antagonists of a native PRO1074 polypeptide.

In still a further embodiment, the invention concerns a composition comprising a PRO1074 polypeptide as hereinabove defined, in combination with a pharmaceutically acceptable carrier.

56. PRO1005

A cDNA clone (DNA57708-1411) has been identified that encodes a novel polypeptide, designated in the present application as "PRO1005."

In one embodiment, the invention provides an isolated nucleic acid molecule comprising DNA encoding a PRO1005 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1005 polypeptide having the sequence of amino acid residues from about 21 to about 185, inclusive of FIG. 139 (SEQ ID NO:211), or (b) the complement of the DNA molecule of (a).

In another aspect, the invention concerns an isolated nucleic acid molecule encoding a PRO1005 polypeptide comprising DNA hybridizing to the complement of the nucleic acid between about residues 90 and about 584, inclusive, of FIG. 138 (SEQ ID NO:210). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203021 (DNA57708-1411), or (b) the complement of the DNA molecule of (a). In a preferred embodiment, the nucleic acid comprises a DNA encoding the same mature polypeptide encoded by the human protein cDNA in ATCC Deposit No. 203021 (DNA57708-1411).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 185, inclusive of FIG. 139 (SEQ ID NO:211), or the complement of the DNA of (a).

In a further aspect, the invention concerns an isolated nucleic acid molecule having at least 50 nucleotides, and preferably at least 100 nucleotides, and produced by hybridizing a test DNA molecule under stringent conditions with (a) a DNA molecule encoding a PRO1005 polypeptide having the sequence of amino acid residues from about 21 to about 185, inclusive of FIG. 139 (SEQ ID NO:211), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1005 polypeptide, with or without the N-terminal signal sequence, or is complementary to such encoding nucleic acid molecule. The signal peptide has been tentatively identified as extending from amino acid position 1 through about amino acid position 20 in the sequence of FIG. 139 (SEQ ID NO:211).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 185, inclusive of FIG. 139 (SEQ ID NO:211), or (b) the complement of the DNA of (a).

Another embodiment is directed to fragments of a PRO1005 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1005 polypeptide encoded by any of the isolated nucleic acid sequences hereinabove defined.

In a specific aspect, the invention provides isolated native sequence PRO1005 polypeptide, which in one embodiment, includes an amino acid sequence comprising residues 21 to 185 of FIG. 139 (SEQ ID NO:211).

In another aspect, the invention concerns an isolated PRO1005 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 185, inclusive of FIG. 139 (SEQ ID NO:211).

In a further aspect, the invention concerns an isolated PRO1005 polypeptide, comprising an amino acid sequence scoring at least about 80% positives, preferably at least about 85% positives, more preferably at least about 90% positives, most preferably at least about 95% positives when compared with the amino acid sequence of residues 21 to 185 of FIG. 139 (SEQ ID NO:211).

In yet another aspect, the invention concerns an isolated PRO1005 polypeptide, comprising the sequence of amino acid residues 21 to about 185, inclusive of FIG. 139 (SEQ ID NO:211), or a fragment thereof sufficient to provide a binding site for an anti-PRO1005 antibody. Preferably, the PRO1005 fragment retains a qualitative biological activity of a native PRO1005 polypeptide.

In a still further aspect, the invention provides a polypeptide produced by (i) hybridizing a test DNA molecule under stringent conditions with (a) a DNA molecule encoding a PRO1005 polypeptide having the sequence of amino acid residues from about 21 to about 185, inclusive of FIG. 139 (SEQ ID NO:211), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

57. PRO1073

A cDNA clone (DNA57710-1451) has been identified that encodes a novel polypeptide, designated in the present application as "PRO1073."

In one embodiment, the invention provides an isolated nucleic acid molecule comprising DNA encoding a PRO1073 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1073 polypeptide having the sequence of amino acid residues from about 32 to about 299, inclusive of FIG. 141 (SEQ ID NO:213), or (b) the complement of the DNA molecule of (a).

In another aspect, the invention concerns an isolated nucleic acid molecule encoding a PRO1073 polypeptide comprising DNA hybridizing to the complement of the nucleic acid between about residues 438 and about 1241, inclusive, of FIG. 140 (SEQ ID NO:212). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203048 (DNA57710-1451), or (b) the complement of the DNA molecule of (a). In a preferred embodiment, the nucleic acid comprises a DNA encoding the same mature polypeptide encoded by the human protein cDNA in ATCC Deposit No. 203048 (DNA57710-1451).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 32 to about 299, inclusive of FIG. 141 (SEQ ID NO:213), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1073 polypeptide having the sequence of amino acid residues from about 32 to about 299, inclusive of FIG. 141 (SEQ ID NO:213), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1073 polypeptide, with or without the N-terminal signal sequence and/or the initiating methionine, or is complementary to such encoding nucleic acid molecule. The signal peptide has been tentatively identified as extending from amino acid position 1 through about amino acid position 31 in the sequence of FIG. 141 (SEQ ID NO:213).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 32 to about 299, inclusive of FIG. 141 (SEQ ID NO:213), or (b) the complement of the DNA of (a).

Another embodiment is directed to fragments of a PRO1073 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1073 polypeptide encoded by any of the isolated nucleic acid sequences hereinabove defined.

In a specific aspect, the invention provides isolated native sequence PRO1073 polypeptide, which in one embodiment, includes an amino acid sequence comprising residues 32 to 299 of FIG. 141 (SEQ ID NO:213).

In another aspect, the invention concerns an isolated PRO1073 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 32 to about 299, inclusive of FIG. 141 (SEQ ID NO:213).

In a further aspect, the invention concerns an isolated PRO1073 polypeptide, comprising an amino acid sequence scoring at least about 80% positives, preferably at least about 85% positives, more preferably at least about 90% positives, most preferably at least about 95% positives when compared with the amino acid sequence of residues 32 to 299 of FIG. 141 (SEQ ID NO:213).

In yet another aspect, the invention concerns an isolated PRO1073 polypeptide, comprising the sequence of amino acid residues 32 to about 299, inclusive of FIG. 141 (SEQ ID NO:213), or a fragment thereof sufficient to provide a binding site for an anti-PRO1073 antibody. Preferably, the PRO1073 fragment retains a qualitative biological activity of a native PRO1073 polypeptide.

In a still further aspect, the invention provides a polypeptide produced by (i) hybridizing a test DNA molecule under stringent conditions with (a) a DNA molecule encoding a PRO1073 polypeptide having the sequence of amino acid residues from about 32 to about 299, inclusive of FIG. 141 (SEQ ID NO:213), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

58. PRO1152

A cDNA clone (DNA57711-1501) has been identified that encodes a novel transmembrane polypeptide, designated in the present application as "PRO1152".

In one embodiment, the invention provides an isolated nucleic acid molecule comprising DNA encoding a PRO1152 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1152 polypeptide having the sequence of amino acid residues from about 1 or about 29 to about 479, inclusive of FIG. 144 (SEQ ID NO:216), or (b) the complement of the DNA molecule of (a).

In another aspect, the invention concerns an isolated nucleic acid molecule encoding a PRO1152 polypeptide comprising DNA hybridizing to the complement of the nucleic acid between about nucleotides 58 or about 142 and about 1494, inclusive, of FIG. 143 (SEQ ID NO:215). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203047 (DNA57711-1501) or (b) the complement of the nucleic acid molecule of (a). In a preferred embodiment, the nucleic acid comprises a DNA encoding the same mature polypeptide encoded by the human protein cDNA in ATCC Deposit No. 203047 (DNA57711-1501).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 479, inclusive of FIG. 144 (SEQ ID NO:216), or (b) the complement of the DNA of (a).

In a further aspect, the invention concerns an isolated nucleic acid molecule having at least 300 nucleotides and produced by hybridizing a test DNA molecule under stringent conditions with (a) a DNA molecule encoding a PRO1152 polypeptide having the sequence of amino acid residues from 1 or about 29 to about 479, inclusive of FIG. 144 (SEQ ID NO:216), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1152 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 28 in the sequence of FIG. 144 (SEQ ID NO:216). The various transmembrane domains have been tentatively identified as extending from about amino acid position 133 to about amino acid position 155, from about amino acid position 168 to about amino acid position 187, from about amino acid position 229 to about amino acid position 247, from about amino acid position 264 to about amino acid position 285, from about amino acid position 309 to about amino acid position 330, from about amino acid position 371 to about amino acid position 390 and from about amino acid position 441 to about amino acid position 464 in the PRO1152 amino acid sequence (FIG. 144, SEQ ID NO:216).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 479, inclusive of FIG. 144 (SEQ ID NO:216), or (b) the complement of the DNA of (a).

Another embodiment is directed to fragments of a PRO1152 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 143 (SEQ ID NO:215).

In another embodiment, the invention provides isolated PRO1152 polypeptide encoded by any of the isolated nucleic acid sequences hereinabove identified.

In a specific aspect, the invention provides isolated native sequence PRO1152 polypeptide, which in certain embodiments, includes an amino acid sequence comprising residues 1 or about 29 to about 479 of FIG. 144 (SEQ ID NO:216).

In another aspect, the invention concerns an isolated PRO1152 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 479, inclusive of FIG. 144 (SEQ ID NO:216).

In a further aspect, the invention concerns an isolated PRO1152 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 479, inclusive of FIG. 144 (SEQ ID NO:216).

In yet another aspect, the invention concerns an isolated PRO1152 polypeptide, comprising the sequence of amino acid residues 1 or about 29 to about 479, inclusive of FIG. 144 (SEQ ID NO:216), or a fragment thereof sufficient to provide a binding site for an anti-PRO1152 antibody. Preferably, the PRO1152 fragment retains a qualitative biological activity of a native PRO1152 polypeptide.

In a still further aspect, the invention provides a polypeptide produced by (i) hybridizing a test DNA molecule under stringent conditions with (a) a DNA molecule encoding a PRO1152 polypeptide having the sequence of amino acid residues from about 1 or about 29 to about 479, inclusive of FIG. 144 (SEQ ID NO:216), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides a nucleic aid molecule designated herein as DNA55807 comprising the nucleotide sequence of SEQ ID NO:217 (see FIG. 145).

59. PRO1136

A cDNA clone (DNA57827-1493) has been identified, having homology to nucleic acid encoding PDZ domain-containing proteins that encodes a novel polypeptide, designated in the present application as "PRO1136".

In one embodiment, the invention provides an isolated nucleic acid molecule comprising DNA encoding a PRO1136 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1136 polypeptide having the sequence of amino acid residues from about 1 or about 16 to about 632, inclusive of FIG. 147 (SEQ ID NO:219), or (b) the complement of the DNA molecule of (a).

In another aspect, the invention concerns an isolated nucleic acid molecule encoding a PRO1136 polypeptide comprising DNA hybridizing to the complement of the nucleic acid between about nucleotides 216 or about 261 and about 2111, inclusive, of FIG. 146 (SEQ ID NO:218). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203045 (DNA57827-1493) or (b) the complement of the nucleic acid molecule of (a). In a preferred embodiment, the nucleic acid comprises a DNA encoding the same mature polypeptide encoded by the human protein cDNA in ATCC Deposit No. 203045 (DNA57827-1493).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 632, inclusive of FIG. 147 (SEQ ID NO:219), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1136 polypeptide having the sequence of amino acid residues from 1 or about 16 to about 632, inclusive of FIG. 147 (SEQ ID NO:219), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1136 polypeptide, with or without the N-terminal signal sequence and/or the initiating methionine, or is complementary to such encoding nucleic acid molecule. The signal peptide has been tentatively identified as extending from about amino acid position 1 to about amino acid position 15 in the sequence of FIG. 147 (SEQ ID NO:219).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 632, inclusive of FIG. 147 (SEQ ID NO:219), or (b) the complement of the DNA of (a).

Another embodiment is directed to fragments of a PRO1136 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 146 (SEQ ID NO:218).

In another embodiment, the invention provides isolated PRO1136 polypeptide encoded by any of the isolated nucleic acid sequences hereinabove identified.

In a specific aspect, the invention provides isolated native sequence PRO1136 polypeptide, which in certain embodiments, includes an amino acid sequence comprising residues 1 or about 16 to about 632 of FIG. 147 (SEQ ID NO:219).

In another aspect, the invention concerns an isolated PRO1136 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 632, inclusive of FIG. 147 (SEQ ID NO:219).

In a further aspect, the invention concerns an isolated PRO1136 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 632, inclusive of FIG. 147 (SEQ ID NO:219).

In yet another aspect, the invention concerns an isolated PRO1136 polypeptide, comprising the sequence of amino acid residues 1 or about 16 to about 632, inclusive of FIG. 147 (SEQ ID NO:219), or a fragment thereof sufficient to provide a binding site for an anti-PRO1136 antibody. Preferably, the PRO1136 fragment retains a qualitative biological activity of a native PRO1136 polypeptide.

In a still further aspect, the invention provides a polypeptide produced by (i) hybridizing a test DNA molecule under stringent conditions with (a) a DNA molecule encoding a PRO1136 polypeptide having the sequence of amino acid residues from about 1 or about 16 to about 632, inclusive of FIG. 147 (SEQ ID NO:219), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1136 polypeptide. In a particular embodiment, the agonist or antagonist is an anti-PRO1136 antibody.

In a further embodiment, the invention concerns a method of identifying agonists or antagonists of a native PRO1136 polypeptide by contacting the native PRO1136 polypeptide with a candidate molecule and monitoring a biological activity mediated by said polypeptide.

In a still further embodiment, the invention concerns a composition comprising a PRO1136 polypeptide, or an agonist or antagonist as hereinabove defined, in combination with a pharmaceutically acceptable carrier.

60. PRO813

Applicants have identified a cDNA clone (DNA57834-1339) having homology to pulmonary surfactant-associated protein C that encodes a novel polypeptide, designated in the present application as "PRO813".

In one embodiment, the invention provides an isolated nucleic acid molecule comprising DNA encoding a PRO813 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO813 polypeptide having the sequence of amino acid residues from about 1 or about 27 to about 176, inclusive of FIG. 149 (SEQ ID NO:221), or (b) the complement of the DNA molecule of (a).

In another aspect, the invention concerns an isolated nucleic acid molecule encoding a PRO813 polypeptide comprising DNA hybridizing to the complement of the nucleic acid between about nucleotides 109 or about 187 and about 636, inclusive, of FIG. 148 (SEQ ID NO:220). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209954 (DNA57834-1339). In a preferred embodiment, the nucleic acid comprises a DNA encoding the same mature polypeptide encoded by the human protein cDNA in ATCC Deposit No. 209954 (DNA57834-1339).

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 27 to about 176, inclusive of FIG. 149 (SEQ ID NO:221).

In a specific aspect, the invention provides an isolated nucleic acid molecule comprising DNA encoding a PRO813 polypeptide, with or without the N-terminal signal sequence and/or the initiating methionine, or is complementary to such encoding nucleic acid molecule. The signal peptide has been tentatively identified as extending from about amino acid position 1 to about amino acid position 26 in the sequence of FIG. 149 (SEQ ID NO:221).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 or about 27 to about 176, inclusive of FIG. 149 (SEQ ID NO:221).

Another embodiment is directed to fragments of a PRO813 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO813 polypeptide encoded by any of the isolated nucleic acid sequences hereinabove identified.

In a specific aspect, the invention provides isolated native sequence PRO813 polypeptide, which in one embodiment, includes an amino acid sequence comprising residues 1 or about 27 to about 176 of FIG. 149 (SEQ ID NO:221).

In another aspect, the invention concerns an isolated PRO813 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 27 to about 176, inclusive of FIG. 149 (SEQ ID NO:221).

In a further aspect, the invention concerns an isolated PRO813 polypeptide, comprising an amino acid sequence scoring at least about 80% positives, preferably at least about 85% positives, more preferably at least about 90% positives, most preferably at least about 95% positives when compared with the amino acid sequence of residues 1 or about 27 to about 176, inclusive of FIG. 149 (SEQ ID NO:221).

In yet another aspect, the invention concerns an isolated PRO813 polypeptide, comprising the sequence of amino acid residues 1 or about 27 to about 176, inclusive of FIG. 149 (SEQ ID NO:221), or a fragment thereof sufficient to provide a binding site for an anti-PRO813 antibody. Preferably, the PRO813 fragment retains a qualitative biological activity of a native PRO813 polypeptide.

In another aspect, the present invention is directed to fragments of a PRO813 polypeptide which are sufficiently long to provide an epitope against which an antibody may be generated.

In yet another embodiment, the invention concerns agonists and antagonists of a native PRO813 polypeptide. In a particular embodiment, the agonist or antagonist is an anti-PRO813 antibody.

In a further embodiment, the invention concerns screening assays to identify agonists or antagonists of a native PRO813 polypeptide.

In still a further embodiment, the invention concerns a composition comprising a PRO813 polypeptide, or an agonist or antagonist as hereinabove defined, in combination with a pharmaceutically acceptable carrier.

61. PRO809

A cDNA clone (DNA57836-1338) has been identified, having sequence identity with heparan sulfate proteoglycans, that encodes a novel polypeptide, designated in the present application as "PRO809."

In one embodiment, the invention provides an isolated nucleic acid molecule comprising DNA encoding a PRO809 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO809 polypeptide having the sequence of amino acid residues from about 1 or 19 to about 265, inclusive of FIG. 151 (SEQ ID NO:223), or (b) the complement of the DNA molecule of (a). The term "or" as used herein to refer to amino or nucleic acids is meant to refer to two alternative embodiments provided herein, i.e., 1–265, or in another embodiment, 19–265.

In another aspect, the invention concerns an isolated nucleic acid molecule encoding a PRO809 polypeptide comprising DNA hybridizing to the complement of the nucleic acid between about residues 63 or 117 and about 867, inclusive, of FIG. 150 (SEQ ID NO:222). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203025 (DNA57836-1338), or (b) the complement of the DNA molecule of (a). In a preferred embodiment, the nucleic acid comprises a DNA encoding the same mature polypeptide encoded by the human protein cDNA in ATCC Deposit No. 203025 (DNA57836-1338).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 19 to about 265, inclusive of FIG. 151 (SEQ ID NO:223), or the complement of the DNA of (a).

In a further aspect, the invention concerns an isolated nucleic acid molecule produced by hybridizing a test DNA molecule under stringent conditions with (a) a DNA molecule encoding a PRO809 polypeptide having the sequence of amino acid residues from about 1 or 19 to about 265, inclusive of FIG. 151 (SEQ ID NO:223), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 19 to about 265, inclusive of FIG. 151 (SEQ ID NO:223), or (b) the complement of the DNA of (a).

In another embodiment, the invention provides isolated PRO809 polypeptide encoded by any of the isolated nucleic acid sequences hereinabove defined.

In a specific aspect, the invention provides isolated native sequence PRO809 polypeptide, which in one embodiment, includes an amino acid sequence comprising residues 1 or 19 through 265 of FIG. 151 (SEQ ID NO:223).

In another aspect, the invention concerns an isolated PRO809 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 19 to about 265, inclusive of FIG. 151 (SEQ ID NO:223).

In a further aspect, the invention concerns an isolated PRO809 polypeptide, comprising an amino acid sequence scoring at least about 80% positives, preferably at least about 85% positives, more preferably at least about 90% positives, most preferably at least about 95% positives when compared with the amino acid sequence of residues 1 or 19 through 265 of FIG. 151 (SEQ ID NO:223).

In a still further aspect, the invention provides a polypeptide produced by (i) hybridizing a test DNA molecule under stringent conditions with (a) a DNA molecule encoding a PRO809 polypeptide having the sequence of amino acid residues from about 1 or 19 to about 265, inclusive of FIG. 151 (SEQ ID NO:223), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO809 polypeptide. In a particular embodiment, the agonist or antagonist is an anti-PRO809 antibody.

In a further embodiment, the invention concerns a method of identifying agonists or antagonists of a native PRO809 polypeptide, by contacting the native PRO809 polypeptide with a candidate molecule and monitoring a biological activity mediated by said polypeptide.

In a still further embodiment, the invention concerns a composition comprising a PRO809 polypeptide, or an agonist or antagonist as hereinabove defined, in combination with a pharmaceutically acceptable carrier.

62. PRO791

A cDNA clone (DNA57838-1337) has been identified, having sequence identity with MHC class I antigens that encodes a novel polypeptide, designated in the present application as "PRO791."

In one embodiment, the invention provides an isolated nucleic acid molecule comprising DNA encoding a PRO791 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO791 polypeptide having the sequence of amino acid residues from about 1 or 26 to about 246, inclusive of FIG. 153 (SEQ ID NO:225), or (b) the complement of the DNA molecule of (a). The term "or" as used herein to refer to amino or nucleic acids is meant to refer to two alternative embodiments provided herein, i.e., 1–246, or in another embodiment, 26–246.

In another aspect, the invention concerns an isolated nucleic acid molecule encoding a PRO791 polypeptide comprising DNA hybridizing to the complement of the nucleic acid between about residues 9 or 84 and about 746, inclusive, of FIG. 152 (SEQ ID NO:224). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203014 (DNA57838-1337), or (b) the complement of the DNA molecule of (a). In a preferred embodiment, the nucleic acid comprises a DNA encoding the same mature polypeptide encoded by the human protein cDNA in ATCC Deposit No. 203014 (DNA57838-1337).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 26 to about 246, inclusive of FIG. 153 (SEQ ID NO:225), or the complement of the DNA of (a).

In a further aspect, the invention concerns an isolated nucleic acid molecule produced by hybridizing a test DNA molecule under stringent conditions with (a) a DNA molecule encoding a PRO791 polypeptide having the sequence of amino acid residues from about 1 or 26 to about 246, inclusive of FIG. 153 (SEQ ID NO:225), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 26 to about 246, inclusive of FIG. 153 (SEQ ID NO:225), or (b) the complement of the DNA of (a).

In another embodiment, the invention provides isolated PRO791 polypeptide encoded by any of the isolated nucleic acid sequences hereinabove defined.

In a specific aspect, the invention provides isolated native sequence PRO791 polypeptide, which in one embodiment, includes an amino acid sequence comprising residues 1 or 26 through 246 of FIG. 153 (SEQ ID NO:225).

In another aspect, the invention concerns an isolated PRO791 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 26 to about 246, inclusive of FIG. 153 (SEQ ID NO:225).

In a further aspect, the invention concerns an isolated PRO791 polypeptide, comprising an amino acid sequence scoring at least about 80% positives, preferably at least about 85% positives, more preferably at least about 90% positives, most preferably at least about 95% positives when compared with the amino acid sequence of residues 1 or 26 through 246 of FIG. 153 (SEQ ID NO:225).

In a still further aspect, the invention provides a polypeptide produced by (i) hybridizing a test DNA molecule under stringent conditions with (a) a DNA molecule encoding a PRO791 polypeptide having the sequence of amino acid residues from about 1 or 26 to about 246, inclusive of FIG. 153 (SEQ ID NO:225), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO791 polypeptide. In a particular embodiment, the agonist or antagonist is an anti-PRO791 antibody.

In a further embodiment, the invention concerns a method of identifying agonists or antagonists of a native PRO791 polypeptide, by contacting the native PRO791 polypeptide with a candidate molecule and monitoring a biological activity mediated by said polypeptide.

In a still further embodiment, the invention concerns a composition comprising a PRO791 polypeptide, or an agonist or antagonist as hereinabove defined, in combination with a pharmaceutically acceptable carrier.

63. PRO1004

A cDNA clone (DNA57844-1410) has been identified that encodes a novel polypeptide, designated in the present application as "PRO1004."

In one embodiment, the invention provides an isolated nucleic acid molecule comprising DNA encoding a PRO1004 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1004 polypeptide having the sequence of amino acid residues from about 25 to about 115, inclusive of FIG. 155 (SEQ ID NO:227), or (b) the complement of the DNA molecule of (a).

In another aspect, the invention concerns an isolated nucleic acid molecule encoding a PRO1004 polypeptide comprising DNA hybridizing to the complement of the nucleic acid between about residues 191 and about 463, inclusive, of FIG. 154 (SEQ ID NO:226). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203010 (DNA57844-1410), or (b) the complement of the DNA molecule of (a). In a preferred embodiment, the nucleic acid comprises a DNA encoding the same mature polypeptide encoded by the human protein cDNA in ATCC Deposit No. 203010 (DNA57844-1410).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 25 to about 115, inclusive of FIG. 155 (SEQ ID NO:227), or the complement of the DNA of (a).

In a further aspect, the invention concerns an isolated nucleic acid molecule having at least 50 nucleotides, and preferably at least 100 nucleotides, and produced by hybridizing a test DNA molecule under stringent conditions with (a) a DNA molecule encoding a PRO1004 polypeptide having the sequence of amino acid residues from about 25 to about 115, inclusive of FIG. 155 (SEQ ID NO:227), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1004 polypeptide, with or without the N-terminal signal sequence and/or the initiating methionine, or is complementary to such encoding nucleic acid molecule. The signal peptide has been tentatively identified as extending from about amino acid position 1 through about amino acid position 24 in the sequence of FIG. 155 (SEQ ID NO:227).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 25 to about 115, inclusive of FIG. 155 (SEQ ID NO:227), or (b) the complement of the DNA of (a).

Another embodiment of the invention is directed to fragments of a PRO1004 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1004 polypeptide encoded by any of the isolated nucleic acid sequences hereinabove defined.

In a specific aspect, the invention provides isolated native sequence PRO1004 polypeptide, which in one embodiment, includes an amino acid sequence comprising residues 25 to 115 of FIG. 155 (SEQ ID NO:227).

In another aspect, the invention concerns an isolated PRO1004 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 25 to about 115, inclusive of FIG. 155 (SEQ ID NO:227).

In a further aspect, the invention concerns an isolated PRO1004 polypeptide, comprising an amino acid sequence scoring at least about 80% positives, preferably at least about 85% positives, more preferably at least about 90% positives, most preferably at least about 95% positives when compared with the amino acid sequence of residues 25 to 115 of FIG. 155 (SEQ ID NO:227).

In yet another aspect, the invention concerns an isolated PRO1004 polypeptide, comprising the sequence of amino acid residues 25 to about 115, inclusive of FIG. 155 (SEQ ID NO:227), or a fragment thereof sufficient to provide a binding site for an anti-PRO1004 antibody. Preferably, the PRO1004 fragment retains a qualitative biological activity of a native PRO1004 polypeptide.

In a still further aspect, the invention provides a polypeptide produced by (i) hybridizing a test DNA molecule under stringent conditions with (a) a DNA molecule encoding a PRO1004 polypeptide having the sequence of amino acid residues from about 25 to about 115, inclusive of FIG. 155 (SEQ ID NO:227), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

64. PRO1111

A cDNA clone (DNA58721-1475) has been identified that encodes a novel polypeptide having sequence identity with LIG and designated in the present application as "PRO1111."

In one embodiment, the invention provides an isolated nucleic acid molecule comprising DNA encoding a PRO1111 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1111 polypeptide having the sequence of amino acid residues from about 1 to about 653, inclusive of FIG. 157 (SEQ ID NO:229), or (b) the complement of the DNA molecule of (a).

In another aspect, the invention concerns an isolated nucleic acid molecule encoding a PRO1111 polypeptide comprising DNA hybridizing to the complement of the nucleic acid between about residues 57 and about 2015, inclusive, of FIG. 156 (SEQ ID NO:228). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203110 (DNA58721-1475), or (b) the complement of the DNA molecule of (a). In a preferred embodiment, the nucleic acid comprises a DNA encoding the same mature polypeptide encoded by the human protein cDNA in ATCC Deposit No. 203110 (DNA58721-1475).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 653, inclusive of FIG. 157 (SEQ ID NO:229), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1111 polypeptide having the sequence of amino acid residues from about 1 to about 653, inclusive of FIG. 157 (SEQ ID NO:229), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1111 polypeptide in its soluble form, i.e. transmembrane domain deleted or inactivated variants, or is complementary to such encoding nucleic acid molecule. The transmembrane domains has been tentatively identified as extending from about amino acid positions 21–40 (type II) and 528–548 in the PRO1111 amino acid sequence (FIG. 157, SEQ ID NO:229).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 653, inclusive of FIG. 157 (SEQ ID NO:229), or (b) the complement of the DNA of (a).

Another embodiment is directed to fragments of a PRO1111 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1111 polypeptide encoded by any of the isolated nucleic acid sequences hereinabove defined.

In a specific aspect, the invention provides isolated native sequence PRO1111 polypeptide, which in one embodiment, includes an amino acid sequence comprising residues 1 through 653 of FIG. 157 (SEQ ID NO:229).

In another aspect, the invention concerns an isolated PRO1111 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 653, inclusive of FIG. 157 (SEQ ID NO:229).

In a further aspect, the invention concerns an isolated PRO1111 polypeptide, comprising an amino acid sequence scoring at least about 80% positives, preferably at least about 85% positives, more preferably at least about 90% positives, most preferably at least about 95% positives when compared with the amino acid sequence of residues 1 through 653 of FIG. 157 (SEQ ID NO:229).

In yet another aspect, the invention concerns an isolated PRO1111 polypeptide, comprising the sequence of amino acid residues 1 to about 653, inclusive of FIG. 157 (SEQ ID NO:229), or a fragment thereof sufficient to provide a binding site for an anti-PRO1111 antibody. Preferably, the PRO1111 fragment retains a qualitative biological activity of a native PRO1111 polypeptide.

In a still further aspect, the invention provides a polypeptide produced by (i) hybridizing a test DNA molecule under stringent conditions with (a) a DNA molecule encoding a PRO1111 polypeptide having the sequence of amino acid residues from about 1 to about 653, inclusive of FIG. 157 (SEQ ID NO:229), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1111 polypeptide. In a particular embodiment, the agonist or antagonist is an anti-PRO1111 antibody.

In a further embodiment, the invention concerns a method of identifying agonists or antagonists of a native PRO1111 polypeptide, by contacting the native PRO1111 polypeptide with a candidate molecule and monitoring a biological activity mediated by said polypeptide.

In a still further embodiment, the invention concerns a composition comprising a PRO1111 polypeptide, or an agonist or antagonist as hereinabove defined, in combination with a pharmaceutically acceptable carrier.

65. PRO1344

A cDNA clone (DNA58723-1588) has been identified, having homology to nucleic acid encoding factor C that encodes a novel polypeptide, designated in the present application as "PRO1344".

In one embodiment, the invention provides an isolated nucleic acid molecule comprising DNA encoding a PRO1344 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1344 polypeptide having the sequence of amino acid residues from about 1 or about 24 to about 720, inclusive of FIG. 159 (SEQ ID NO:231), or (b) the complement of the DNA molecule of (a).

In another aspect, the invention concerns an isolated nucleic acid molecule encoding a PRO1344 polypeptide comprising DNA hybridizing to the complement of the nucleic acid between about nucleotides 26 or about 95 and about 2185, inclusive, of FIG. 158 (SEQ ID NO:230). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203133 (DNA58723-1588) or (b) the complement of the nucleic acid molecule of (a). In a preferred embodiment, the nucleic acid comprises a DNA encoding the same mature polypeptide encoded by the human protein cDNA in ATCC Deposit No. 203133 (DNA58723-1588).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 24 to about 720, inclusive of FIG. 159 (SEQ ID NO:231), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1344 polypeptide having the sequence of amino acid residues from 1 or about 24 to about 720, inclusive of FIG. 159 (SEQ ID NO:231), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1344 polypeptide, with or without the N-terminal signal sequence and/or the initiating methionine, or is complementary to such encoding nucleic acid molecule. The signal peptide has been tentatively identified as extending from about amino acid position 1 to about amino acid position 23 in the sequence of FIG. 159 (SEQ ID NO:231).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 24 to about 720, inclusive of FIG. 159 (SEQ ID NO:231), or (b) the complement of the DNA of (a).

Another embodiment is directed to fragments of a PRO1344 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 158 (SEQ ID NO:230).

In another embodiment, the invention provides isolated PRO1344 polypeptide encoded by any of the isolated nucleic acid sequences hereinabove identified.

In a specific aspect, the invention provides isolated native sequence PRO1344 polypeptide, which in certain embodiments, includes an amino acid sequence comprising residues 1 or about 24 to about 720 of FIG. 159 (SEQ ID NO:231).

In another aspect, the invention concerns an isolated PRO1344 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 24 to about 720, inclusive of FIG. 159 (SEQ ID NO:231).

In a further aspect, the invention concerns an isolated PRO1344 polypeptide, comprising an amino acid sequence scoring at least about 80% positives, preferably at least about 85% positives, more preferably at least about 90% positives, most preferably at least about 95% positives when compared with the amino acid sequence of residues 1 or about 24 to about 720, inclusive of FIG. 159 (SEQ ID NO:231).

In yet another aspect, the invention concerns an isolated PRO1344 polypeptide, comprising the sequence of amino acid residues 1 or about 24 to about 720, inclusive of FIG. 159 (SEQ ID NO:231), or a fragment thereof sufficient to provide a binding site for an anti-PRO1344 antibody. Preferably, the PRO1344 fragment retains a qualitative biological activity of a native PRO1344 polypeptide.

In a still further aspect, the invention provides a polypeptide produced by (i) hybridizing a test DNA molecule under stringent conditions with (a) a DNA molecule encoding a PRO1344 polypeptide having the sequence of amino acid residues from about 1 or about 24 to about 720, inclusive of FIG. 159 (SEQ ID NO:231), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1344 polypeptide. In a particular embodiment, the agonist or antagonist is an anti-PRO1344 antibody.

In a further embodiment, the invention concerns a method of identifying agonists or antagonists of a native PRO1344 polypeptide by contacting the native PRO1344 polypeptide with a candidate molecule and monitoring a biological activity mediated by said polypeptide.

In a still further embodiment, the invention concerns a composition comprising a PRO1344 polypeptide, or an agonist or antagonist as hereinabove defined, in combination with a pharmaceutically acceptable carrier.

66. PRO1109

A cDNA clone (DNA58737-1473) has been identified, having homology to nucleic acid encoding β-1,4-galactosyltransferase, that encodes a novel polypeptide, designated in the present application as "PRO1109".

In one embodiment, the invention provides an isolated nucleic acid molecule comprising DNA encoding a PRO1109 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1109 polypeptide having the sequence of amino acid residues from about 1 or about 28 to about 344, inclusive of FIG. 161 (SEQ ID NO:236), or (b) the complement of the DNA molecule of (a).

In another aspect, the invention concerns an isolated nucleic acid molecule encoding a PRO1109 polypeptide comprising DNA hybridizing to the complement of the nucleic acid between about nucleotides 119 or about 200 and about 1150, inclusive, of FIG. 160 (SEQ ID NO:235). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203136 (DNA58737-1473) or (b) the complement of the nucleic acid molecule of (a). In a preferred embodiment, the nucleic acid comprises a DNA encoding the same mature polypeptide encoded by the human protein cDNA in ATCC Deposit No. 203136 (DNA58737-1473).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 28 to about 344, inclusive of FIG. 161 (SEQ ID NO:236), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1109 polypeptide having the sequence of amino acid residues from 1 or about 28 to about 344, inclusive of FIG. 161 (SEQ ID NO:236), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1109 polypeptide, with or without the N-terminal signal sequence and/or the initiating methionine, or is complementary to such encoding nucleic acid molecule. The signal peptide has been tentatively identified as extending from about amino acid position 1 to about amino acid position 27 in the sequence of FIG. 161 (SEQ ID NO:236).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 28 to about 344, inclusive of FIG. 161 (SEQ ID NO:236), or (b) the complement of the DNA of (a).

Another embodiment is directed to fragments of a PRO1109 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 160 (SEQ ID NO:235).

In another embodiment, the invention provides isolated PRO1109 polypeptide encoded by any of the isolated nucleic acid sequences hereinabove identified.

In a specific aspect, the invention provides isolated native sequence PRO1109 polypeptide, which in certain embodiments, includes an amino acid sequence comprising residues 1 or about 28 to about 344 of FIG. 161 (SEQ ID NO:236).

In another aspect, the invention concerns an isolated PRO1109 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 28 to about 344, inclusive of FIG. 161 (SEQ ID NO:236).

In a further aspect, the invention concerns an isolated PRO1109 polypeptide, comprising an amino acid sequence scoring at least about 80% positives, preferably at least about 85% positives, more preferably at least about 90% positives, most preferably at least about 95% positives when compared with the amino acid sequence of residues 1 or about 28 to about 344, inclusive of FIG. 161 (SEQ ID NO:236).

In yet another aspect, the invention concerns an isolated PRO1109 polypeptide, comprising the sequence of amino acid residues 1 or about 28 to about 344, inclusive of FIG. 161 (SEQ ID NO:236), or a fragment thereof sufficient to provide a binding site for an anti-PRO1109 antibody. Preferably, the PRO1109 fragment retains a qualitative biological activity of a native PRO1109 polypeptide.

In a still further aspect, the invention provides a polypeptide produced by (i) hybridizing a test DNA molecule under stringent conditions with (a) a DNA molecule encoding a PRO1109 polypeptide having the sequence of amino acid residues from about 1 or about 28 to about 344, inclusive of FIG. 161 (SEQ ID NO:236), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1109 polypeptide. In a particular embodiment, the agonist or antagonist is an anti-PRO1109 antibody.

In a further embodiment, the invention concerns a method of identifying agonists or antagonists of a native PRO1109 polypeptide by contacting the native PRO1109 polypeptide with a candidate molecule and monitoring a biological activity mediated by said polypeptide.

In a still further embodiment, the invention concerns a composition comprising a PRO1109 polypeptide, or an agonist or antagonist as hereinabove defined, in combination with a pharmaceutically acceptable carrier.

67. PRO1383

A cDNA clone (DNA58743-1609) has been identified, having homology to nucleic acid encoding the human melanoma cell-expressed protein nmb, that encodes a novel polypeptide, designated in the present application as "PRO1383".

In one embodiment, the invention provides an isolated nucleic acid molecule comprising DNA encoding a PRO1383 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1383 polypeptide having the sequence of amino acid residues from about 1 or about 25 to about 423, inclusive of FIG. 163 (SEQ ID NO:241), or (b) the complement of the DNA molecule of (a).

In another aspect, the invention concerns an isolated nucleic acid molecule encoding a PRO1383 polypeptide comprising DNA hybridizing to the complement of the nucleic acid between about nucleotides 122 or about 194 and about 1390, inclusive, of FIG. 162 (SEQ ID NO:240). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203154 (DNA58743-1609) or (b) the complement of the nucleic acid molecule of (a). In a preferred embodiment, the nucleic acid comprises a DNA encoding the same mature polypeptide encoded by the human protein cDNA in ATCC Deposit No. 203154 (DNA58743-1609).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 423, inclusive of FIG. 163 (SEQ ID NO:241), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1383 polypeptide having the sequence of amino acid residues from 1 or about 25 to about 423, inclusive of FIG. 163 (SEQ ID NO:241), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1383 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 24 in the sequence of FIG. 163 (SEQ ID NO:241). The transmembrane domain has been tentatively identified as extending from about amino acid position 339 to about amino acid position 362 in the PRO1383 amino acid sequence (FIG. 163, SEQ ID NO:241).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 25 to about 423, inclusive of FIG. 163 (SEQ ID NO:241), or (b) the complement of the DNA of (a).

Another embodiment is directed to fragments of a PRO1383 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 162 (SEQ ID NO:240).

In another embodiment, the invention provides isolated PRO1383 polypeptide encoded by any of the isolated nucleic acid sequences hereinabove identified.

In a specific aspect, the invention provides isolated native sequence PRO1383 polypeptide, which in certain embodiments, includes an amino acid sequence comprising residues 1 or about 25 to about 423 of FIG. 163 (SEQ ID NO:241).

In another aspect, the invention concerns an isolated PRO1383 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to about 423, inclusive of FIG. 163 (SEQ ID NO:241).

In a further aspect, the invention concerns an isolated PRO1383 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 423, inclusive of FIG. 163 (SEQ ID NO:241).

In yet another aspect, the invention concerns an isolated PRO1383 polypeptide, comprising the sequence of amino acid residues 1 or about 25 to about 423, inclusive of FIG. 163 (SEQ ID NO:241), or a fragment thereof sufficient to provide a binding site for an anti-PRO1383 antibody. Preferably, the PRO1383 fragment retains a qualitative biological activity of a native PRO1383 polypeptide.

In a still further aspect, the invention provides a polypeptide produced by (i) hybridizing a test DNA molecule under stringent conditions with (a) a DNA molecule encoding a PRO1383 polypeptide having the sequence of amino acid residues from about 1 or about 25 to about 423, inclusive of FIG. 163 (SEQ ID NO:241), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1383 polypeptide. In a particular embodiment, the agonist or antagonist is an anti-PRO1383 antibody.

In a further embodiment, the invention concerns a method of identifying agonists or antagonists of a native PRO1383 polypeptide by contacting the native PRO1383 polypeptide with a candidate molecule and monitoring a biological activity mediated by said polypeptide.

In a still further embodiment, the invention concerns a composition comprising a PRO1383 polypeptide, or an agonist or antagonist as hereinabove defined, in combination with a pharmaceutically acceptable carrier.

68. PRO1003

Applicants have identified a cDNA clone, DNA58846-1409, that encodes a novel secreted polypeptide wherein the polypeptide is designated in the present application as "PRO1003".

In one embodiment, the invention provides an isolated nucleic acid molecule comprising DNA encoding a PRO1003 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1003 polypeptide having the sequence of amino acid residues from 1 or about 25 to about 84, inclusive of FIG. 165 (SEQ ID NO:246), or (b) the complement of the DNA molecule of (a).

In another aspect, the invention concerns an isolated nucleic acid molecule encoding a PRO1003 polypeptide comprising DNA that hybridizes to the complement of the nucleic acid between about residues 41 or about 113 and about 292 inclusive of FIG. 164 (SEQ ID NO:245). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209957 (DNA58846-1409), which was deposited on Jun. 9, 1998. In a preferred embodiment, the nucleic acid comprises a DNA molecule encoding the same mature polypeptide encoded by the human protein cDNA in ATCC Deposit No. 209957 (DNA58846-1409).

In an additional aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 84, inclusive of FIG. 165 (SEQ ID NO:246).

In another aspect, the invention concerns an isolated nucleic acid molecule comprising DNA encoding a polypeptide scoring at least about 80% positives, preferably at least about 90% positives, most preferably at least about 95% positives when compared with the amino acid sequence of residues 1 or about 25 to about 84, inclusive of FIG. 165 (SEQ ID NO:246).

Another embodiment is directed to fragments of a PRO1003 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1003 polypeptide encoded by any of the isolated nucleic acid sequences hereinabove identified.

In a specific aspect, the invention provides isolated native sequence PRO1003 polypeptide, which in one embodiment, includes an amino acid sequence comprising residues 1 or about 25 to 84 of FIG. 165 (SEQ ID NO:246).

In another aspect, the invention concerns an isolated PRO1003 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to 84, inclusive of FIG. 165 (SEQ ID NO:246).

In a further aspect, the invention concerns an isolated PRO1003 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 84 of FIG. 165 (SEQ ID NO:246).

In yet another aspect, the invention concerns an isolated PRO1003 polypeptide, comprising the sequence of amino acid residues 1 or about 25 to about 84, inclusive of FIG. 165 (SEQ ID NO:246), or a fragment thereof sufficient to provide a binding site for an anti-PRO1003 antibody. Preferably, the PRO1003 fragment retains a qualitative biological activity of a native PRO1003 polypeptide.

In another aspect, the present invention is directed to fragments of a PRO1003 polypeptide which are sufficiently long to provide an epitope against which an antibody may be generated.

69. PRO1108

Applicants have identified a cDNA clone (DNA58848-1472) having homology to nucleic acid encoding the LPAAT protein that encodes a novel polypeptide, designated in the present application as "PRO1108".

In one embodiment, the invention provides an isolated nucleic acid molecule comprising DNA encoding a PRO1108 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1108 polypeptide having the sequence of amino acid residues from about 1 to about 456, inclusive of FIG. 167 (SEQ ID NO:248), or (b) the complement of the DNA molecule of (a).

In another aspect, the invention concerns an isolated nucleic acid molecule encoding a PRO1108 polypeptide comprising DNA hybridizing to the complement of the nucleic acid between about nucleotides 77 and about 1444, inclusive, of FIG. 166 (SEQ ID NO:247). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209955 (DNA58848-1472). In a preferred embodiment, the nucleic acid comprises a DNA encoding the same mature polypeptide encoded by the human protein cDNA in ATCC Deposit No. 209955 (DNA58848-1472).

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 to about 456, inclusive of FIG. 167 (SEQ ID NO:248).

In a specific aspect, the invention provides an isolated nucleic acid molecule comprising DNA encoding a PRO1108 polypeptide, with or without the initiating methionine, and its soluble, i.e., transmembrane domain deleted or inactivated variants, or is complementary to such encoding nucleic acid molecule. The transmembrane domains have been tentatively identified as being type II domains extending from about amino acid position 22 to about amino acid position 42, from about amino acid position 156 to about amino acid position 176, from about amino acid position 180 to about amino acid position 199 and from about amino acid position 369 to about amino acid position 388 in the PRO1108 amino acid sequence (FIG. 167, SEQ ID NO:248).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 to about 456, inclusive of FIG. 167 (SEQ ID NO:248).

Another embodiment is directed to fragments of a PRO1108 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1108 polypeptide encoded by any of the isolated nucleic acid sequences hereinabove identified.

In a specific aspect, the invention provides isolated native sequence PRO1108 polypeptide, which in one embodiment, includes an amino acid sequence comprising residues 1 to about 456 of FIG. 167 (SEQ ID NO:248).

In another aspect, the invention concerns an isolated PRO1108 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 456, inclusive of FIG. 167 (SEQ ID NO:248).

In a further aspect, the invention concerns an isolated PRO1108 polypeptide, comprising an amino acid sequence scoring at least about 80% positives, preferably at least about 85% positives, more preferably at least about 90% positives, most preferably at least about 95% positives when compared with the amino acid sequence of residues 1 to about 456, inclusive of FIG. 167 (SEQ ID NO:248).

In yet another aspect, the invention concerns an isolated PRO1108 polypeptide, comprising the sequence of amino acid residues 1 to about 456, inclusive of FIG. 167 (SEQ ID NO:248), or a fragment thereof sufficient to provide a binding site for an anti-PRO1108 antibody. Preferably, the PRO1108 fragment retains a qualitative biological activity of a native PRO1108 polypeptide.

In another aspect, the present invention is directed to fragments of a PRO1108 polypeptide which are sufficiently long to provide an epitope against which an antibody may be generated.

In yet another embodiment, the invention concerns agonists and antagonists of a native PRO1108 polypeptide. In a particular embodiment, the agonist or antagonist is an anti-PRO1108 antibody.

In a further embodiment, the invention concerns screening assays to identify agonists or antagonists of a native PRO1108 polypeptide.

In still a further embodiment, the invention concerns a composition comprising a PRO1108 polypeptide, or an agonist or antagonist as hereinabove defined, in combination with a pharmaceutically acceptable carrier.

70. PRO1137

Applicants have identified a cDNA clone, DNA58849-1494, that encodes a novel polypeptide having homology to ribosyltransferase wherein the polypeptide is designated in the present application as "PRO1137".

In one embodiment, the invention provides an isolated nucleic acid molecule comprising DNA encoding a PRO1137 polypeptide.

In one aspect, the isolated nucleic acid comprises DNA having at least about 80% sequence identity, preferably at least about 85% sequence identity, more preferably at least about 90% sequence identity, and most preferably at least about 95% sequence identity to (a) a DNA molecule encoding a PRO1137 polypeptide having the sequence of amino acid residues from 1 or about 15 to about 240, inclusive of FIG. 169 (SEQ ID NO:250), or (b) the complement of the DNA molecule of (a).

In another aspect, the invention concerns an isolated nucleic acid molecule encoding a PRO1137 polypeptide comprising DNA that hybridizes to the complement of the nucleic acid sequence having about residues 77 or about 119 to about 796, inclusive of FIG. 168 (SEQ ID NO:249). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, and most preferably at least about 95% sequence identity to (a) a DNA molecule encoding the same mature polypeptide encoded by the human protein cDNA in ATCC Deposit No. 209958 (DNA58849-1494), which was deposited on Jun. 9, 1998, or (b) the complement of the DNA molecule of (a).

In a preferred embodiment, the nucleic acid comprises a DNA molecule encoding the same mature polypeptide encoded by the human protein cDNA in ATCC Deposit No. 209958 (DNA58849-1494).

In a still further aspect, the invention concerns an isolated nucleic acid molecule comprising DNA encoding a polypeptide having at least about 80% sequence identity, preferably at least about 85% sequence identity, more preferably at least about 90% sequence identity, and most preferably at least about 95% sequence identity to the sequence of amino acid residues 1 or about 15 to about 240, inclusive of FIG. 169 (SEQ ID NO:250).

In a specific aspect, the invention provides an isolated nucleic acid molecule comprising DNA encoding a PRO1137 polypeptide with or without the N-terminal signal sequence and/or the initiating methionine, or the complement of such encoding DNA molecule. The signal peptide has been tentatively identified as extending from about amino acid position 1 to about amino acid position 14 in the sequence of FIG. 169 (SEQ ID NO:250).

In another aspect, the invention concerns an isolated nucleic acid molecule comprising DNA encoding a polypeptide scoring at least about 80% positives, preferably at least about 90% positives, and most preferably at least about 95% positives when compared with the amino acid sequence of residues 1 or about 15 to about 240, inclusive of FIG. 169 (SEQ ID NO:250).

Another embodiment is directed to fragments of a PRO1137 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1137 polypeptide encoded by any of the isolated nucleic acid sequences hereinabove identified.

In a specific aspect, the invention provides isolated native sequence PRO1137 polypeptide, which in one embodiment, includes an amino acid sequence comprising residues 1 or about 15 to 240 of FIG. 169 (SEQ ID NO:250).

In another aspect, the invention concerns an isolated PRO1137 polypeptide, comprising an amino acid sequence having at least about 80% sequence identity, preferably at least about 85% sequence identity, more preferably at least about 90% sequence identity, and most preferably at least about 95% sequence identity to the sequence of amino acid residues 1 or about 15 to 240, inclusive of FIG. 169 (SEQ ID NO:250).

In a further aspect, the invention concerns an isolated PRO1137 polypeptide, comprising an amino acid sequence scoring at least about 80% positives, preferably at least about 85% positives, more preferably at least about 90% positives, and most preferably at least about 95% positives when compared with the amino acid sequence of residues 1 or about 15 to about 240 of FIG. 169 (SEQ ID NO:250).

In yet another aspect, the invention concerns an isolated PRO1137 polypeptide, comprising the sequence of amino acid residues 1 or about 15 to about 240, inclusive of FIG. 169 (SEQ ID NO:250), or a fragment thereof sufficient to provide a binding site for an anti-PRO1137 antibody. Preferably, the PRO1137 fragment retains a qualitative biological activity of a native PRO1137 polypeptide.

In another aspect, the present invention is directed to fragments of a PRO1137 polypeptide which are sufficiently long to provide an epitope against which an antibody may be generated.

In yet another embodiment, the invention concerns agonist and antagonists of the PRO1137 polypeptide. In a particular embodiment, the agonist or antagonist is an anti-PRO1137 antibody.

In a further embodiment, the invention concerns screening assays to identify agonists or antagonists of a native PRO1137 polypeptide.

In still a further embodiment, the invention concerns a composition comprising a PRO1137 polypeptide as hereinabove defined, in combination with a pharmaceutically acceptable carrier.

71. PRO1138

Applicants have identified a cDNA clone, DNA58850-1495, that encodes a novel polypeptide having homology to CD84 leukocyte antigen wherein the polypeptide is designated in the present application as "PRO1138".

In one embodiment, the invention provides an isolated nucleic acid molecule comprising DNA encoding a PRO1138 polypeptide.

In one aspect, the isolated nucleic acid comprises DNA having at least about 80% sequence identity, preferably at least about 85% sequence identity, more preferably at least about 90% sequence identity, and most preferably at least about 95% sequence identity to (a) a DNA molecule encoding a PRO1138 polypeptide having the sequence of amino acid residues from 1 or about 23 to about 335, inclusive of FIG. 171 (SEQ ID NO:253), or (b) the complement of the DNA molecule of (a).

In another aspect, the invention concerns an isolated nucleic acid molecule encoding a PRO1138 polypeptide comprising DNA that hybridizes to the complement of the nucleic acid sequence having about residues 38 or about 104 to about 1042, inclusive of FIG. 170 (SEQ ID NO:252). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, and most preferably at least about 95% sequence identity to (a) a DNA molecule encoding the same mature polypeptide encoded by the human protein cDNA in ATCC Deposit No. 209956 (DNA58850-1495), which was deposited on Jun. 9, 1998, or (b) the complement of the DNA molecule of (a).

In a preferred embodiment, the nucleic acid comprises a DNA molecule encoding the same mature polypeptide encoded by the human protein cDNA in ATCC Deposit No. 209956 (DNA58850-1495).

In a still further aspect, the invention concerns an isolated nucleic acid molecule comprising DNA encoding a polypeptide having at least about 80% sequence identity, preferably at least about 85% sequence identity, more preferably at least about 90% sequence identity, and most preferably at least about 95% sequence identity to the sequence of amino acid residues 1 or about 23 to about 335, inclusive of FIG. 171 (SEQ ID NO:253).

In a specific aspect, the invention provides an isolated nucleic acid molecule comprising DNA encoding a PRO1138 extracellular domain (ECD), with or without the N-terminal signal sequence and/or the initiating methionine, and its soluble variants (i.e. transmembrane domain(s) deleted or inactivated) or is complementary to such encoding nucleic acid molecule. The signal peptide has been tentatively identified as extending from amino acid position 1 to about amino acid position 22 in the sequence of FIG. 171 (SEQ ID NO:253). A transmembrane domain region has been tentatively identified as extending from about amino acid position 224 to about amino acid position 250 in the PRO1138 amino acid sequence (FIG. 171, SEQ ID NO:253).

In another aspect, the invention concerns an isolated nucleic acid molecule comprising DNA encoding a polypeptide scoring at least about 80% positives, preferably at least about 90% positives, and most preferably at least about 95% positives when compared with the amino acid sequence of residues 1 or about 23 to about 335, inclusive of FIG. 171 (SEQ ID NO:253).

Another embodiment is directed to fragments of a PRO1138 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1138 polypeptide encoded by any of the isolated nucleic acid sequences hereinabove identified.

In a specific aspect, the invention provides isolated native sequence PRO1138 polypeptide, which in one embodiment, includes an amino acid sequence comprising residues 1 or about 23 to 335 of FIG. 171 (SEQ ID NO:253).

In another aspect, the invention concerns an isolated PRO1138 polypeptide, comprising an amino acid sequence having at least about 80% sequence identity, preferably at least about 85% sequence identity, more preferably at least about 90% sequence identity, and most preferably at least about 95% sequence identity to the sequence of amino acid residues 1 or about 23 to 335, inclusive of FIG. 171 (SEQ ID NO:253).

In a further aspect, the invention concerns an isolated PRO1138 polypeptide, comprising an amino acid sequence scoring at least about 80% positives, preferably at least about 85% positives, more preferably at least about 90% positives, and most preferably at least about 95% positives when compared with the amino acid sequence of residues 1 or about 23 to about 335 of FIG. 171 (SEQ ID NO:253).

In another aspect, the invention concerns a PRO1138 extracellular domain comprising an amino acid sequence having at least about 80% sequence identity, preferably at least about 85% sequence identity, more preferably at least about 90% sequence identity, and most preferably at least about 95% sequence identity to the sequence of amino acid residues 1 or about 23 to X of FIG. 171 (SEQ ID NO:253), wherein X is any one of amino acid residues 219 to 228 of FIG. 171 (SEQ ID NO:253).

In yet another aspect, the invention concerns an isolated PRO1138 polypeptide, comprising the sequence of amino acid residues 1 or about 23 to about 335, inclusive of FIG. 171 (SEQ ID NO:253), or a fragment thereof sufficient to provide a binding site for an anti-PRO1138 antibody. Preferably, the PRO1138 fragment retains a qualitative biological activity of a native PRO1138 polypeptide.

In another aspect, the present invention is directed to fragments of a PRO1138 polypeptide which are sufficiently long to provide an epitope against which an antibody may be generated.

In yet another embodiment, the invention concerns agonist and antagonists of the PRO1138 polypeptide. In a particular embodiment, the agonist or antagonist is an anti-PRO1138 antibody.

In a further embodiment, the invention concerns screening assays to identify agonists or antagonists of a native PRO1138 polypeptide.

In still a further embodiment, the invention concerns a composition comprising a PRO1138 polypeptide as hereinabove defined, in combination with a pharmaceutically acceptable carrier.

In another embodiment, the invention provides a nucleotide sequence designated herein as DNA49140 comprising the nucleotide sequence of FIG. 172 (SEQ ID NO:254).

72. PRO1054

A cDNA clone (DNA58853-1423) has been identified, having homology to nucleic acid encoding majaor urinary proteins (MUPs) that encodes a novel polypeptide, designated in the present application as "PRO1054".

In one embodiment, the invention provides an isolated nucleic acid molecule comprising DNA encoding a PRO1054 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1054 polypeptide having the sequence of amino acid residues from about 1 or about 19 to about 180, inclusive of FIG. 174 (SEQ ID NO:256), or (b) the complement of the DNA molecule of (a).

In another aspect, the invention concerns an isolated nucleic acid molecule encoding a PRO1054 polypeptide comprising DNA hybridizing to the complement of the nucleic acid between about nucleotides 46 or about 100 and about 585, inclusive, of FIG. 173 (SEQ ID NO:255). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203016 (DNA58853-1423) or (b) the complement of the nucleic acid molecule of (a). In a preferred embodiment, the nucleic acid comprises a DNA encoding the same mature polypeptide encoded by the human protein cDNA in ATCC Deposit No. 203016 (DNA58853-1423).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 19 to about 180, inclusive of FIG. 174 (SEQ ID NO:256), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1054 polypeptide having the sequence of amino acid residues from 1 or about 19 to about 180, inclusive of FIG. 174 (SEQ ID NO:256), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1054 polypeptide, with or without the N-terminal signal sequence and/or the initiating methionine, or is complementary to such encoding nucleic acid molecule. The signal peptide has been tentatively identified as extending from about amino acid position 1 to about amino acid position 18 in the sequence of FIG. 174 (SEQ ID NO:256).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 19 to about 180, inclusive of FIG. 174 (SEQ ID NO:256), or (b) the complement of the DNA of (a).

Another embodiment is directed to fragments of a PRO1054 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 173 (SEQ ID NO:255).

In another embodiment, the invention provides isolated PRO1054 polypeptide encoded by any of the isolated nucleic acid sequences hereinabove identified.

In a specific aspect, the invention provides isolated native sequence PRO1054 polypeptide, which in certain embodiments, includes an amino acid sequence comprising residues 1 or about 19 to about 180 of FIG. 174 (SEQ ID NO:256).

In another aspect, the invention concerns an isolated PRO1054 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to about 180, inclusive of FIG. 174 (SEQ ID NO:256).

In a further aspect, the invention concerns an isolated PRO1054 polypeptide, comprising an amino acid sequence scoring at least about 80% positives, preferably at least about 85% positives, more preferably at least about 90% positives, most preferably at least about 95% positives when compared with the amino acid sequence of residues 1 or about 19 to about 180, inclusive of FIG. 174 (SEQ ID NO:256).

In yet another aspect, the invention concerns an isolated PRO1054 polypeptide, comprising the sequence of amino acid residues 1 or about 19 to about 180, inclusive of FIG. 174 (SEQ ID NO:256), or a fragment thereof sufficient to provide a binding site for an anti-PRO1054 antibody. Preferably, the PRO1054 fragment retains a qualitative biological activity of a native PRO1054 polypeptide.

In a still further aspect, the invention provides a polypeptide produced by (i) hybridizing a test DNA molecule under stringent conditions with (a) a DNA molecule encoding a PRO1054 polypeptide having the sequence of amino acid residues from about 1 or about 19 to about 180, inclusive of FIG. 174 (SEQ ID NO:256), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1054 polypeptide. In a particular embodiment, the agonist or antagonist is an anti-PRO1054 antibody.

In a further embodiment, the invention concerns a method of identifying agonists or antagonists of a native PRO1054 polypeptide by contacting the native PRO1054 polypeptide with a candidate molecule and monitoring a biological activity mediated by said polypeptide.

In a still further embodiment, the invention concerns a composition comprising a PRO1054 polypeptide, or an agonist or antagonist as hereinabove defined, in combination with a pharmaceutically acceptable carrier.

73. PRO994

A cDNA clone (DNA58855-1422) has been identified, having homology to nucleic acid encoding the tumor-associated antigen L6 that encodes a novel polypeptide, designated in the present application as "PRO994".

In one embodiment, the invention provides an isolated nucleic acid molecule comprising DNA encoding a PRO994 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO994 polypeptide having the sequence of amino acid residues from about 1 to about 229, inclusive of FIG. 176 (SEQ ID NO:258), or (b) the complement of the DNA molecule of (a).

In another aspect, the invention concerns an isolated nucleic acid molecule encoding a PRO994 polypeptide comprising DNA hybridizing to the complement of the nucleic acid between about nucleotides 31 and about 717, inclusive, of FIG. 175 (SEQ ID NO:257). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203018 (DNA58855-1422) or (b) the complement of the nucleic acid molecule of (a). In a preferred embodiment, the nucleic acid comprises a DNA encoding the same mature polypeptide encoded by the human protein cDNA in ATCC Deposit No. 203018 (DNA58855-1422).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 229, inclusive of FIG. 176 (SEQ ID NO:258), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO994 polypeptide having the sequence of amino acid residues from 1 to about 229, inclusive of FIG. 176 (SEQ ID NO:258), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO994 polypeptide, with or without the initiating methionine, and its soluble, i.e., transmembrane domain deleted or inactivated variants, or is complementary to such encoding nucleic acid molecule. The multiple transmembrane domains have been tentatively identified as extending from about amino acid position 10 to about amino acid position 31, from about amino acid position 50 to about amino acid position 72, from about amino acid position 87 to about amino acid position 110 and from about amino acid position 191 to about amino acid position 213 in the PRO994 amino acid sequence (FIG. 176, SEQ ID NO:258).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 229, inclusive of FIG. 176 (SEQ ID NO:258), or (b) the complement of the DNA of (a).

Another embodiment is directed to fragments of a PRO994 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 175 (SEQ ID NO:257).

In another embodiment, the invention provides isolated PRO994 polypeptide encoded by any of the isolated nucleic acid sequences hereinabove identified.

In a specific aspect, the invention provides isolated native sequence PRO994 polypeptide, which in certain embodiments, includes an amino acid sequence comprising residues 1 to about 229 of FIG. 176 (SEQ ID NO:258).

In another aspect, the invention concerns an isolated PRO994 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 229, inclusive of FIG. 176 (SEQ ID NO:258).

In a further aspect, the invention concerns an isolated PRO994 polypeptide, comprising an amino acid sequence scoring at least about 80% positives, preferably at least about 85% positives, more preferably at least about 90% positives, most preferably at least about 95% positives when compared with the amino acid sequence of residues 1 to about 229, inclusive of FIG. 176 (SEQ ID NO:258).

In yet another aspect, the invention concerns an isolated PRO994 polypeptide, comprising the sequence of amino acid residues 1 to about 229, inclusive of FIG. 176 (SEQ ID NO:258), or a fragment thereof sufficient to provide a binding site for an anti-PRO994 antibody. Preferably, the PRO994 fragment retains a qualitative biological activity of a native PRO994 polypeptide.

In a still further aspect, the invention provides a polypeptide produced by (i) hybridizing a test DNA molecule under stringent conditions with (a) a DNA molecule encoding a PRO994 polypeptide having the sequence of amino acid residues from about 1 to about 229, inclusive of FIG. 176 (SEQ ID NO:258), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO994 polypeptide. In a particular embodiment, the agonist or antagonist is an anti-PRO994 antibody.

In a further embodiment, the invention concerns a method of identifying agonists or antagonists of a native PRO994 polypeptide by contacting the native PRO994 polypeptide with a candidate molecule and monitoring a biological activity mediated by said polypeptide.

In a still further embodiment, the invention concerns a composition comprising a PRO994 polypeptide, or an agonist or antagonist as hereinabove defined, in combination with a pharmaceutically acceptable carrier.

74. PRO812

A cDNA clone (DNA59205-1421) has been identified, having homology to nucleic acid encoding prostatic steroid-binding protein cl that encodes a novel polypeptide, designated in the present application as "PRO812".

In one embodiment, the invention provides an isolated nucleic acid molecule comprising DNA encoding a PRO812 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO812 polypeptide having the sequence of amino acid residues from about 1 or about 16 to about 83, inclusive of FIG. 178 (SEQ ID NO:260), or (b) the complement of the DNA molecule of (a).

In another aspect, the invention concerns an isolated nucleic acid molecule encoding a PRO812 polypeptide comprising DNA hybridizing to the complement of the nucleic acid between about nucleotides 55 or about 100 and about 303, inclusive, of FIG. 177 (SEQ ID NO:259). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203009 (DNA59205-1421) or (b) the complement of the nucleic acid molecule of (a). In a preferred embodiment, the nucleic acid comprises a DNA encoding the same mature polypeptide encoded by the human protein cDNA in ATCC Deposit No. 203009 (DNA59205-1421).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 83, inclusive of FIG. 178 (SEQ ID NO:260), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO812 polypeptide having the sequence of amino acid residues from 1 or about 16 to about 83, inclusive of FIG. 178 (SEQ ID NO:260), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO812 polypeptide, with or without the N-terminal signal sequence and/or the initiating methionine, or is complementary to such encoding nucleic acid molecule. The signal peptide has been tentatively identified as extending from about amino acid position 1 to about amino acid position 15 in the sequence of FIG. 178 (SEQ ID NO:260).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 83, inclusive of FIG. 178 (SEQ ID NO:260), or (b) the complement of the DNA of (a).

Another embodiment is directed to fragments of a PRO812 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 177 (SEQ ID NO:259).

In another embodiment, the invention provides isolated PRO812 polypeptide encoded by any of the isolated nucleic acid sequences hereinabove identified.

In a specific aspect, the invention provides isolated native sequence PRO812 polypeptide, which in certain embodiments, includes an amino acid sequence comprising residues 1 or about 16 to about 83 of FIG. 178 (SEQ ID NO:260).

In another aspect, the invention concerns an isolated PRO812 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 83, inclusive of FIG. 178 (SEQ ID NO:260).

In a further aspect, the invention concerns an isolated PRO812 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 83, inclusive of FIG. 178 (SEQ ID NO:260).

In yet another aspect, the invention concerns an isolated PRO812 polypeptide, comprising the sequence of amino acid residues 1 or about 16 to about 83, inclusive of FIG. 178 (SEQ ID NO:260), or a fragment thereof sufficient to provide a binding site for an anti-PRO812 antibody. Preferably, the PRO812 fragment retains a qualitative biological activity of a native PRO812 polypeptide.

In a still further aspect, the invention provides a polypeptide produced by (i) hybridizing a test DNA molecule under stringent conditions with (a) a DNA molecule encoding a PRO812 polypeptide having the sequence of amino acid residues from about 1 or about 16 to about 83, inclusive of FIG. 178 (SEQ ID NO:260), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO812 polypeptide. In a particular embodiment, the agonist or antagonist is an anti-PRO812 antibody.

In a further embodiment, the invention concerns a method of identifying agonists or antagonists of a native PRO812 polypeptide by contacting the native PRO812 polypeptide with a candidate molecule and monitoring a biological activity mediated by said polypeptide.

In a still further embodiment, the invention concerns a composition comprising a PRO812 polypeptide, or an agonist or antagonist as hereinabove defined, in combination with a pharmaceutically acceptable carrier.

75. PRO1069

Applicants have identified a cDNA clone, DNA59211-1450, that encodes a novel polypeptide having homology to CHIF wherein the polypeptide is designated in the present application as "PRO1069".

In one embodiment, the invention provides an isolated nucleic acid molecule comprising DNA encoding a PRO1069 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1069 polypeptide having the sequence of amino acid residues from 1 or about 17 to about 89, inclusive of FIG. 180 (SEQ ID NO:262), or (b) the complement of the DNA molecule of (a).

In another aspect, the invention concerns an isolated nucleic acid molecule encoding a PRO1069 polypeptide comprising DNA that hybridizes to the complement of the nucleic acid sequence having about residues 197 or about 245 to about 463, inclusive of FIG. 179 (SEQ ID NO:261). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209960 (DNA59211-1450), which was deposited on Jun. 9, 1998. In a preferred embodiment, the nucleic acid comprises a DNA molecule encoding the same mature polypeptide encoded by the human protein cDNA in ATCC Deposit No. 209960 (DNA59211-1450).

In a still further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 17 to about 89, inclusive of FIG. 180 (SEQ ID NO:262).

In a specific aspect, the invention provides an isolated nucleic acid molecule comprising DNA encoding a PRO1069 extracellular domain (ECD), with or without the N-terminal signal sequence and/or the initiating methionine, and its soluble variants (i.e. transmembrane domain(s) deleted or inactivated) or is complementary to such encoding nucleic acid molecule. The signal peptide has been tentatively identified as extending from amino acid position 1 to about amino acid position 16 in the sequence of FIG. 180 (SEQ ID NO:262). A transmembrane domain region has been tentatively identified as extending from about amino acid position 36 to about amino acid position 59 in the PRO1069 amino acid sequence (FIG. 180, SEQ ID NO:262).

In another aspect, the invention concerns an isolated nucleic acid molecule comprising DNA encoding a polypeptide scoring at least about 80% positives, preferably at least about 90% positives, most preferably at least about 95% positives when compared with the amino acid sequence of residues 1 or about 17 to about 89, inclusive of FIG. 180 (SEQ ID NO:262).

Another embodiment is directed to fragments of a PRO1069 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1069 polypeptide encoded by any of the isolated nucleic acid sequences hereinabove identified.

In a specific aspect, the invention provides isolated native sequence PRO1069 polypeptide, which in one embodiment, includes an amino acid sequence comprising residues 1 or about 17 to 89 of FIG. 180 (SEQ ID NO:262).

In another aspect, the invention concerns an isolated PRO1069 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 17 to 89, inclusive of FIG. 180 (SEQ ID NO:262).

In a further aspect, the invention concerns an isolated PRO1069 polypeptide, comprising an amino acid sequence scoring at least about 80% positives, preferably at least about 85% positives, more preferably at least about 90% positives, most preferably at least about 95% positives when compared with the amino acid sequence of residues 1 or about 17 to about 89 of FIG. 180 (SEQ ID NO:262).

In another aspect, the invention concerns a PRO1069 extracellular domain comprising an amino acid sequence having at least about 80% sequence identity, preferably at least about 85% sequence identity, more preferably at least about 90% sequence identity, most preferably at least about 95% sequence identity to the sequence of amino acid residues 1 or about 17 to X of FIG. 180 (SEQ ID NO:262), wherein X is any one of amino acid residues 32 to 41 of FIG. 180 (SEQ ID NO:262).

In yet another aspect, the invention concerns an isolated PRO1069 polypeptide, comprising the sequence of amino acid residues 1 or about 17 to about 89, inclusive of FIG. 180 (SEQ ID NO:262), or a fragment thereof sufficient to provide a binding site for an anti-PRO1069 antibody. Preferably, the PRO1069 fragment retains a qualitative biological activity of a native PRO1069 polypeptide.

In another aspect, the present invention is directed to fragments of a PRO1069 polypeptide which are sufficiently long to provide an epitope against which an antibody may be generated.

In yet another embodiment, the invention concerns agonist and antagonists of the PRO1069 polypeptide. In a particular embodiment, the agonist or antagonist is an anti-PRO1069 antibody.

In a further embodiment, the invention concerns screening assays to identify agonists or antagonists of a native PRO1069 polypeptide.

In still a further embodiment, the invention concerns a composition comprising a PRO1069 polypeptide as hereinabove defined, in combination with a pharmaceutically acceptable carrier.

76. PRO1129

Applicants have identified a cDNA clone (DNA59213-1487) having homology to nucleic acid encoding cytochrome P-450 family members that encodes a novel polypeptide, designated in the present application as "PRO1129".

In one embodiment, the invention provides an isolated nucleic acid molecule comprising DNA encoding a PRO1129 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1129 polypeptide having the sequence of amino acid residues from about 1 to about 524, inclusive of FIG. 182 (SEQ ID NO:264), or (b) the complement of the DNA molecule of (a).

In another aspect, the invention concerns an isolated nucleic acid molecule encoding a PRO1129 polypeptide comprising DNA hybridizing to the complement of the nucleic acid between about nucleotides 42 and about 1613, inclusive, of FIG. 181 (SEQ ID NO:263). Preferably, hybridization occurs under stringent hybridization and wash conditions.

In another aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209959 (DNA59213-1487). In a preferred embodiment, the nucleic acid comprises a DNA encoding the same mature polypeptide encoded by the human protein cDNA in ATCC Deposit No. 209959 (DNA59213-1487).

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 to about 524, inclusive of FIG. 182 (SEQ ID NO:264).

In a specific aspect, the invention provides an isolated nucleic acid molecule comprising DNA encoding a PRO1129 polypeptide, with or without the initiating methionine, and its soluble, i.e., transmembrane domain deleted or inactivated variants, or is complementary to such encoding nucleic acid molecule. The type II transmembrane domains have been tentatively identified as extending from about amino acid position 13 to about amino acid position 32 and from about amino acid position 77 to about amino acid position 102 in the PRO1129 amino acid sequence (FIG. 182, SEQ ID NO:264).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 to about 524, inclusive of FIG. 182 (SEQ ID NO:264).

Another embodiment is directed to fragments of a PRO1129 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1129 polypeptide encoded by any of the isolated nucleic acid sequences hereinabove identified.

In a specific aspect, the invention provides isolated native sequence PRO1129 polypeptide, which in one embodiment, includes an amino acid sequence comprising residues 1 to about 524 of FIG. 182 (SEQ ID NO:264).

In another aspect, the invention concerns an isolated PRO1129 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 524, inclusive of FIG. 182 (SEQ ID NO:264).

In a further aspect, the invention concerns an isolated PRO1129 polypeptide, comprising an amino acid sequence scoring at least about 80% positives, preferably at least about 85% positives, more preferably at least about 90% positives, most preferably at least about 95% positives when compared with the amino acid sequence of residues 1 to about 524, inclusive of FIG. 182 (SEQ ID NO:264).

In yet another aspect, the invention concerns an isolated PRO1129 polypeptide, comprising the sequence of amino acid residues 1 to about 524, inclusive of FIG. 182 (SEQ ID NO:264), or a fragment thereof sufficient to provide a binding site for an anti-PRO1129 antibody. Preferably, the PRO1129 fragment retains a qualitative biological activity of a native PRO1129 polypeptide.

In another aspect, the present invention is directed to fragments of a PRO1129 polypeptide which are sufficiently long to provide an epitope against which an antibody may be generated.

In yet another embodiment, the invention concerns agonists and antagonists of a native PRO1129 polypeptide. In a particular embodiment, the agonist or antagonist is an anti-PRO1129 antibody.

In a further embodiment, the invention concerns screening assays to identify agonists or antagonists of a native PRO1129 polypeptide.

In still a further embodiment, the invention concerns a composition comprising a PRO1129 polypeptide, or an agonist or antagonist as hereinabove defined, in combination with a pharmaceutically acceptable carrier.

77. PRO1068

A cDNA clone (DNA59214-1449) has been identified, that encodes a novel polypeptide having homology to urotensin and designated the present application as "PRO1068."

In one embodiment, the invention provides an isolated nucleic acid molecule comprising DNA encoding a PRO1068 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1068 polypeptide having the sequence of amino acid residues from about 21 to about 124, inclusive of FIG. 184 (SEQ ID NO:266), or (b) the complement of the DNA molecule of (a).

In another aspect, the invention concerns an isolated nucleic acid molecule encoding a PRO1068 polypeptide comprising DNA hybridizing to the complement of the nucleic acid between about residues 102 and about 413, inclusive, of FIG. 183 (SEQ ID NO:265). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203046 (DNA59214-1449), or (b) the complement of the DNA molecule of (a). In a preferred embodiment, the nucleic acid comprises a DNA encoding the same mature polypeptide encoded by the human protein cDNA in ATCC Deposit No. 203046 (DNA59214-1449).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 124, inclusive of FIG. 184 (SEQ ID NO:266), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1068 polypeptide having the sequence of amino acid residues from about 21 to about 124, inclusive of FIG. 184 (SEQ ID NO:266), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1068 polypeptide, with or without the N-terminal signal sequence and/or the initiating methionine, or is complementary to such encoding nucleic acid molecule. The signal peptide has been tentatively identified as extending from amino acid position 1 through about amino acid position 20 in the sequence of FIG. 184 (SEQ ID NO:266).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 124, inclusive of FIG. 184 (SEQ ID NO:266), or (b) the complement of the DNA of (a).

Another embodiment is directed to fragments of a PRO1068 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1068 polypeptide encoded by any of the isolated nucleic acid sequences hereinabove defined.

In a specific aspect, the invention provides isolated native sequence PRO1068 polypeptide, which in one embodiment, includes an amino acid sequence comprising residues 21 to 124 of FIG. 184 (SEQ ID NO:266).

In another aspect, the invention concerns an isolated PRO1068 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 124, inclusive of FIG. 184 (SEQ ID NO:266).

In a further aspect, the invention concerns an isolated PRO1068 polypeptide, comprising an amino acid sequence scoring at least about 80% positives, preferably at least about 85% positives, more preferably at least about 90% positives, most preferably at least about 95% positives when compared with the amino acid sequence of residues 21 to 124 of FIG. 184 (SEQ ID NO:266).

In yet another aspect, the invention concerns an isolated PRO1068 polypeptide, comprising the sequence of amino acid residues 21 to about 124, inclusive of FIG. 184 (SEQ ID NO:266), or a fragment thereof sufficient to provide a binding site for an anti-PRO1068 antibody. Preferably, the PRO1068 fragment retains a qualitative biological activity of a native PRO1068 polypeptide.

In a still further aspect, the invention provides a polypeptide produced by (i) hybridizing a test DNA molecule under stringent conditions with (a) a DNA molecule encoding a PRO1068 polypeptide having the sequence of amino acid residues from about 21 to about 124, inclusive of FIG. 184 (SEQ ID NO:266), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1068 polypeptide. In a particular embodiment, the agonist or antagonist is an anti-PRO1068 antibody.

In a further embodiment, the invention concerns a method of identifying agonists or antagonists of a native PRO1068 polypeptide, by contacting the native PRO1068 polypeptide with a candidate molecule and monitoring a biological activity mediated by said polypeptide.

In a still further embodiment, the invention concerns a composition comprising a PRO1068 polypeptide, or an agonist or antagonist as hereinabove defined, in combination with a pharmaceutically acceptable carrier.

78. PRO1066

Applicants have identified a cDNA clone (DNA59215-1425) that encodes a novel secreted polypeptide, designated in the present application as "PRO1066".

In one embodiment, the invention provides an isolated nucleic acid molecule comprising DNA encoding a PRO1066 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1066 polypeptide having the sequence of amino acid residues from about 1 or about 24 to about 117, inclusive of FIG. 186 (SEQ ID NO:268), or (b) the complement of the DNA molecule of (a).

In another aspect, the invention concerns an isolated nucleic acid molecule encoding a PRO1066 polypeptide comprising DNA hybridizing to the complement of the nucleic acid between about nucleotides 176 or about 245 and about 527, inclusive, of FIG. 185 (SEQ ID NO:267). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209961 (DNA59215-1425). In a preferred embodiment, the nucleic acid comprises a DNA encoding the same mature polypeptide encoded by the human protein cDNA in ATCC Deposit No. 209961 (DNA59215-1425).

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 24 to about 117, inclusive of FIG. 186 (SEQ ID NO:268).

In a specific aspect, the invention provides an isolated nucleic acid molecule comprising DNA encoding a PRO1066 polypeptide, with or without the N-terminal signal sequence and/or the initiating methionine, or is complementary to such encoding nucleic acid molecule. The signal peptide has been tentatively identified as extending from about amino acid position 1 to about amino acid position 23 in the sequence of FIG. 186 (SEQ ID NO:268).

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 or about 24 to about 117, inclusive of FIG. 186 (SEQ ID NO:268).

Another embodiment is directed to fragments of a PRO1066 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1066 polypeptide encoded by any of the isolated nucleic acid sequences hereinabove identified.

In a specific aspect, the invention provides isolated native sequence PRO1066 polypeptide, which in one embodiment, includes an amino acid sequence comprising residues 1 or about 24 to about 117 of FIG. 186 (SEQ ID NO:268).

In another aspect, the invention concerns an isolated PRO1066 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 24 to about 117, inclusive of FIG. 186 (SEQ ID NO:268).

In a further aspect, the invention concerns an isolated PRO1066 polypeptide, comprising an amino acid sequence scoring at least about 80% positives, preferably at least about 85% positives, more preferably at least about 90% positives, most preferably at least about 95% positives when compared with the amino acid sequence of residues 1 or about 24 to about 117, inclusive of FIG. 186 (SEQ ID NO:268).

In yet another aspect, the invention concerns an isolated PRO1066 polypeptide, comprising the sequence of amino acid residues 1 or about 24 to about 117, inclusive of FIG. 186 (SEQ ID NO:268), or a fragment thereof sufficient to provide a binding site for an anti-PRO1066 antibody. Preferably, the PRO1066 fragment retains a qualitative biological activity of a native PRO1066 polypeptide.

In another aspect, the present invention is directed to fragments of a PRO1066 polypeptide which are sufficiently long to provide an epitope against which an antibody may be generated.

79. PRO1184

Applicants have identified a cDNA clone (DNA59220-1514) that encodes a novel secreted polypeptide, designated in the present application as "PRO1184".

In one embodiment, the invention provides an isolated nucleic acid molecule comprising DNA encoding a PRO1184 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1184 polypeptide having the sequence of amino acid residues from 1 or about 39 through 142 of FIG. 188 (SEQ ID NO:270), or (b) the complement of the DNA molecule of (a).

In another aspect, the invention concerns an isolated nucleic acid molecule encoding a PRO1184 polypeptide comprising DNA hybridizing to the complement of the nucleic acid at about residues 106 or 220 through 531 of SEQ ID NO:269. In another aspect, the invention concerns an isolated nucleic acid molecule encoding a PRO1184 polypeptide comprising DNA hybridizing to the complement of the nucleic of SEQ ID NO:269. Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC of DNA59220-1514.

In a preferred embodiment, the nucleic acid comprises a DNA encoding the same mature polypeptide encoded by the human protein cDNA in ATCC Deposit of DNA59220-1514.

In still a further aspect, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues 1 or about 39 through 142 of SEQ ID NO:270.

In a specific aspect, the invention provides an isolated nucleic acid molecule comprising DNA encoding a PRO1184 polypeptide, with or without the N-terminal signal sequence and/or the initiating methionine, and its soluble variants, or is complementary to such an encoding nucleic acid molecule. The signal peptide has been tentatively identified as extending from amino acid position 1 to about amino acid position 38 of SEQ ID NO:270.

In another aspect, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues 1 or about 39 through 142 of SEQ ID NO:270.

Another embodiment is directed to fragments of a PRO1184 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length.

In another embodiment, the invention provides isolated PRO1184 polypeptide encoded by any of the isolated nucleic acid sequences hereinabove identified.

In a specific aspect, the invention provides isolated native sequence PRO1184 polypeptide, which in one embodiment, includes an amino acid sequence comprising residues 1 or about 39 through 142 of SEQ ID NO:270.

In another aspect, the invention concerns an isolated PRO1184 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 39 through 142 of SEQ ID NO:270.

In a further aspect, the invention concerns an isolated PRO1184 polypeptide, comprising an amino acid sequence scoring at least about 80% positives, preferably at least about 85% positives, more preferably at least about 90% positives, most preferably at least about 95% positives when compared with the amino acid sequence of residues 1 or about 39 through 142 of SEQ ID NO:270.

In yet another aspect, the invention concerns an isolated PRO1184 polypeptide, comprising the sequence of amino acid residues 1 or about 39 through 142 of SEQ ID NO:270, or a fragment thereof sufficient to provide a binding site for an anti-PRO1184 antibody. Preferably, the PRO1184 fragment retains a qualitative biological activity of a native PRO1184 polypeptide.

In another aspect, the present invention is directed to fragments of a PRO1184 polypeptide which are sufficiently long to provide an epitope against which an antibody may be generated.

80. PRO1360

A cDNA clone (DNA59488-1603) has been identified that encodes a novel polypeptide designated in the present application as "PRO1360."

In one embodiment, the invention provides an isolated nucleic acid molecule comprising DNA encoding a PRO1360 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1360 polypeptide having the sequence of amino acid residues from about 30 to about 285, inclusive of FIG. 190 (SEQ ID NO:272), or (b) the complement of the DNA molecule of (a).

In another aspect, the invention concerns an isolated nucleic acid molecule encoding a PRO1360 polypeptide comprising DNA hybridizing to the complement of the nucleic acid between about residues 140 and about 908, inclusive, of FIG. 189 (SEQ ID NO:271). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203157 (DNA59488-1603), or (b) the complement of the DNA molecule of (a). In a preferred embodiment, the nucleic acid comprises a DNA encoding the same mature polypeptide encoded by the human protein cDNA in ATCC Deposit No. 203157 (DNA59488-1603).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 30 to about 285, inclusive of FIG. 190 (SEQ ID NO:272), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1360 polypeptide having the sequence of amino acid residues from about 30 to about 285, inclusive of FIG. 190 (SEQ ID NO:272), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 30 to about 285, inclusive of FIG. 190 (SEQ ID NO:272), or (b) the complement of the DNA of (a).

Another embodiment is directed to fragments of a PRO1360 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1360 polypeptide encoded by any of the isolated nucleic acid sequences hereinabove defined.

In a specific aspect, the invention provides isolated native sequence PRO1360 polypeptide, which in one embodiment, includes an amino acid sequence comprising residues 30 through 285 of FIG. 190 (SEQ ID NO:272).

In another aspect, the invention concerns an isolated PRO1360 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 30 to about 285, inclusive of FIG. 190 (SEQ ID NO:272).

In a further aspect, the invention concerns an isolated PRO1360 polypeptide, comprising an amino acid sequence scoring at least about 80% positives, preferably at least about 85% positives, more preferably at least about 90% positives, most preferably at least about 95% positives when compared with the amino acid sequence of residues 30 through 285 of FIG. 190 (SEQ ID NO:272).

In yet another aspect, the invention concerns an isolated PRO1360 polypeptide, comprising the sequence of amino acid residues 30 to about 285, inclusive of FIG. 190 (SEQ ID NO:272), or a fragment thereof sufficient to provide a binding site for an anti-PRO1360 antibody. Preferably, the PRO1360 fragment retains a qualitative biological activity of a native PRO1360 polypeptide.

In a still further aspect, the invention provides a polypeptide produced by (i) hybridizing a test DNA molecule under stringent conditions with (a) a DNA molecule encoding a PRO1360 polypeptide having the sequence of amino acid residues from about 30 to about 285, inclusive of FIG. 190 (SEQ ID NO:272), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1360 polypeptide. In a particular embodiment, the agonist or antagonist is an anti-PRO1360 antibody.

In a further embodiment, the invention concerns a method of identifying agonists or antagonists of a native PRO1360 polypeptide, by contacting the native PRO1360 polypeptide with a candidate molecule and monitoring a biological activity mediated by said polypeptide.

In a still further embodiment, the invention concerns a composition comprising a PRO1360 polypeptide, or an agonist or antagonist as hereinabove defined, in combination with a pharmaceutically acceptable carrier.

81. PRO1029

A cDNA clone (DNA59493-1420) has been identified that encodes a novel secreted polypeptide, designated in the present application as "PRO1029".

In one embodiment, the invention provides an isolated nucleic acid molecule comprising DNA encoding a PRO1029 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1029 polypeptide having the sequence of amino acid residues from about 1 or about 20 to about 86, inclusive of FIG. 192 (SEQ ID NO:274), or (b) the complement of the DNA molecule of (a).

In another aspect, the invention concerns an isolated nucleic acid molecule encoding a PRO1029 polypeptide comprising DNA hybridizing to the complement of the nucleic acid between about nucleotides 39 or about 96 and about 296, inclusive, of FIG. 191 (SEQ ID NO:274). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203050 (DNA59493-1420) or (b) the complement of the nucleic acid molecule of (a). In a preferred embodiment, the nucleic acid comprises a DNA encoding the same mature polypeptide encoded by the human protein cDNA in ATCC Deposit No. 203050 (DNA59493-1420).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 86, inclusive of FIG. 192 (SEQ ID NO:274), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1029 polypeptide having the sequence of amino acid residues from 1 or about 20 to about 86, inclusive of FIG. 192 (SEQ ID NO:274), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1029 polypeptide, with or without the N-terminal signal sequence and/or the initiating methionine, or is complementary to such encoding nucleic acid molecule. The signal peptide has been tentatively identified as extending from about amino acid position 1 to about amino acid position 19 in the sequence of FIG. 192 (SEQ ID NO:274).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 86, inclusive of FIG. 192 (SEQ ID NO:274), or (b) the complement of the DNA of (a).

Another embodiment is directed to fragments of a PRO1029 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 191 (SEQ ID NO:273).

In another embodiment, the invention provides isolated PRO1029 polypeptide encoded by any of the isolated nucleic acid sequences hereinabove identified.

In a specific aspect, the invention provides isolated native sequence PRO1029 polypeptide, which in certain embodiments, includes an amino acid sequence comprising residues 1 or about 20 to about 86 of FIG. 192 (SEQ ID NO:274).

In another aspect, the invention concerns an isolated PRO1029 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 86, inclusive of FIG. 192 (SEQ ID NO:274).

In a further aspect, the invention concerns an isolated PRO1029 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 86, inclusive of FIG. 192 (SEQ ID NO:274).

In yet another aspect, the invention concerns an isolated PRO1029 polypeptide, comprising the sequence of amino acid residues 1 or about 20 to about 86, inclusive of FIG. 192 (SEQ ID NO:274), or a fragment thereof sufficient to provide a binding site for an anti-PRO1029 antibody. Preferably, the PRO1029 fragment retains a qualitative biological activity of a native PRO1029 polypeptide.

In a still further aspect, the invention provides a polypeptide produced by (i) hybridizing a test DNA molecule under stringent conditions with (a) a DNA molecule encoding a PRO1029 polypeptide having the sequence of amino acid residues from about 1 or about 20 to about 86, inclusive of FIG. 192 (SEQ ID NO:274), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

82. PRO1139

Applicants have identified a novel cDNA clone (DNA59497-1496) that encodes a novel human protein originally designated as PRO1139.

In one embodiment, the invention provides an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding a PRO1139 polypeptide having the sequence of amino acid residues from about 29 to about 131 of FIG. 194 (SEQ ID NO:276), or (b) the complement of the DNA molecule of (a).

In another embodiment, the invention concerns an isolated nucleic acid molecule comprising DNA hybridizing to the complement of the polynucleotide sequence between about residues 80 and 391, inclusive, of FIG. 193 (SEQ ID NO:275). Preferably, hybridization occurs under stringent hybridization and wash conditions.

In a further embodiment, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209941 (DNA59497-1496). In a preferred embodiment, the nucleic acid comprises a DNA encoding the same mature polypeptide encoded by the human protein cDNA in ATCC Deposit No. 209941 (DNA59497-1496).

In a still further embodiment, the invention concerns an isolated nucleic acid molecule comprising DNA encoding a polypeptide having at least about 80% sequence identity, preferably at least about 85% sequence identity, more preferably at least about 90% sequence identity, most preferably at least about 95% sequence identity to the sequence of amino acid residues from about 29 to about 131 of FIG. 194 (SEQ ID NO:276).

In a specific embodiment, the invention provides an isolated nucleic acid molecule comprising DNA encoding a native or variant PRO1139 polypeptide, with or without the N-terminal signal sequence, and with or without the transmembrane regions which have been identified as stretching from about amino acid position 33 to about amino acid position 52; from about amino acid position 71 to about amino acid position 89; and from about amino acid position 98 to about amino acid position 120, respectively of the amino acid sequence of FIG. 194, SEQ ID NO:276. In one aspect, the isolated nucleic acid comprises DNA encoding a mature, full-length native PRO1139 polypeptide having amino acid residues 1 to 131 of FIG. 194, SEQ ID NO:276, or is complementary to such encoding nucleic acid sequence.

In another embodiment, the invention concerns an isolated nucleic acid molecule comprising DNA encoding a polypeptide scoring at least about 80% positives, preferably at least about 85% positives, more preferably at least about 90% positives, most preferably at least about 95% positives when compared with the amino acid sequence of residues from about 29 to about 131 of FIG. 194 (SEQ ID NO:276).

In another embodiment, the invention provides isolated PRO1139 polypeptides. In particular, the invention provides isolated native sequence PRO1139 polypeptide, which in one embodiment, include the amino acid sequence comprising residues 29 to 131 of FIG. 194 (SEQ ID NO:276). The invention also provides for variants of the PRO1139 polypeptide which are encoded by any of the isolated nucleic acid molecules hereinabove defined. Specific variants include, but are not limited to, deletion (truncated) variants of the full-length native sequence PRO1139 which lack the N-terminal signal sequence and/or have at least one transmembrane domain deleted or inactivated. The variants specifically include variants of the full-length mature polypeptide of FIG. 194 (SEQ ID NO:276) in which one or more of the transmembrane regions between amino acid residues 33–52, 71–8, and 98–120, respectively have been deleted or inactivated, and which may additionally have the N-terminal signal sequence (amino acid residues 1–28) and/or the initiating methionine deleted.

In a further embodiment, the invention concerns an isolated PRO1139 polypeptide, comprising an amino acid sequence scoring at least about 80% positives, preferably at least about 85% positives, more preferably at least about 90% positives, most preferably at least about 95% positives when compared with the amino acid sequence of residues from about 29 to about 131 of FIG. 194 (SEQ ID NO:276).

In yet another aspect, the invention concerns an isolated PRO1139 polypeptide, comprising the sequence of amino acid residues 29 to about 131, inclusive of FIG. 194 (SEQ ID NO:276) or a fragment thereof sufficient to provide a binding site for an anti-PRO1139 antibody. Preferably, the PRO1139 fragment retains a qualitative biological activity of a native PRO1139 polypeptide.

In yet another embodiment, the invention concerns agonists and antagonists of the a native PRO1139 polypeptide. In a particular embodiment, the agonist or antagonist is an anti-PRO1139 antibody.

In a further embodiment, the invention concerns screening assays to identify agonists or antagonists of a native PRO1139 polypeptide.

In a still further embodiment, the invention concerns a composition comprising a PRO1139 polypeptide (including variants), or an agonist or antagonist as hereinabove defined, in combination with a pharmaceutically acceptable carrier.

The invention also concerns a method of treating obesity comprising administering to a patient an effective amount of an antagonist of a PRO139 polypeptide. In a specific embodiment, the antagonist is a blocking antibody specifically binding a native PRO1139 polypeptide.

83. PRO1309

A cDNA clone (DNA59588-1571) has been identified that encodes a novel polypeptide having leucine rich repeats and designated in the present application as "PRO1309."

In one embodiment, the invention provides an isolated nucleic acid molecule comprising DNA encoding a PRO1309 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1309 polypeptide having the sequence of amino acid residues from about 35 to about 522, inclusive of FIG. 196 (SEQ ID NO:278), or (b) the complement of the DNA molecule of (a).

In another aspect, the invention concerns an isolated nucleic acid molecule encoding a PRO1309 polypeptide comprising DNA hybridizing to the complement of the nucleic acid between about residues 822 and about 2285, inclusive, of FIG. 195 (SEQ ID NO:277). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203106 (DNA59588-1571), or (b) the complement of the DNA molecule of (a). In a preferred embodiment, the nucleic acid comprises a DNA encoding the same mature polypeptide encoded by the human protein cDNA in ATCC Deposit No. 203106 (DNA59588-1571).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 35 to about 522, inclusive of FIG. 196 (SEQ ID NO:278), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1309 polypeptide having the sequence of amino acid residues from about 35 to about 522, inclusive of FIG. 196 (SEQ ID NO:278), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1309 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 34 in the sequence of FIG. 196 (SEQ ID NO:278). The transmembrane domain has been tentatively identified as extending from about amino acid position 428 through about amino acid position 450 in the PRO1309 amino acid sequence (FIG. 196, SEQ ID NO:278).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 35 to about 522, inclusive of FIG. 196 (SEQ ID NO:278), or (b) the complement of the DNA of (a).

Another embodiment is directed to fragments of a PRO1309 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1309 polypeptide encoded by any of the isolated nucleic acid sequences hereinabove defined.

In a specific aspect, the invention provides isolated native sequence PRO1309 polypeptide, which in one embodiment, includes an amino acid sequence comprising residues 35 through 522 of FIG. 196 (SEQ ID NO:278).

In another aspect, the invention concerns an isolated PRO1309 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 35 to about 522, inclusive of FIG. 196 (SEQ ID NO:278).

In a further aspect, the invention concerns an isolated PRO1309 polypeptide, comprising an amino acid sequence scoring at least about 80% positives, preferably at least about 85% positives, more preferably at least about 90% positives, most preferably at least about 95% positives when compared with the amino acid sequence of residues 35 through 522 of FIG. 196 (SEQ ID NO:278).

In yet another aspect, the invention concerns an isolated PRO1309 polypeptide, comprising the sequence of amino acid residues 35 to about 522, inclusive of FIG. 196 (SEQ ID NO:278), or a fragment thereof sufficient to provide a binding site for an anti-PRO1309 antibody. Preferably, the PRO1309 fragment retains a qualitative biological activity of a native PRO1309 polypeptide.

In a still further aspect, the invention provides a polypeptide produced by (i) hybridizing a test DNA molecule under stringent conditions with (a) a DNA molecule encoding a PRO1309 polypeptide having the sequence of amino acid residues from about 35 to about 522, inclusive of FIG. 196 (SEQ ID NO:278), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1309 polypeptide. In a particular embodiment, the agonist or antagonist is an anti-PRO1309 antibody.

In a further embodiment, the invention concerns a method of identifying agonists or antagonists of a native PRO1309 polypeptide, by contacting the native PRO1309 polypeptide with a candidate molecule and monitoring a biological activity mediated by said polypeptide.

In a still further embodiment, the invention concerns a composition comprising a PRO1309 polypeptide, or an agonist or antagonist as hereinabove defined, in combination with a pharmaceutically acceptable carrier.

84. PRO1028

Applicants have identified a cDNA clone that encodes a secreted novel polypeptide, wherein the polypeptide is designated in the present application as "PRO1028".

In one embodiment, the invention provides an isolated nucleic acid molecule comprising DNA encoding a PRO1028 polypeptide. In one aspect, the isolated nucleic acid comprises DNA encoding the PRO1028 polypeptide having amino acid residues 1 through 197 of FIG. 198 (SEQ ID NO:281), or is complementary to such encoding nucleic acid sequence, and remains stably bound to it under at least moderate, and optionally, under high stringency conditions. The isolated nucleic acid sequence may comprise the cDNA insert of the vector deposited on Jun. 9, 1998 with the ATCC as DNA59603-1419 which includes the nucleotide sequence encoding PRO1028.

In another embodiment, the invention provides isolated PRO1028 polypeptide. In particular, the invention provides isolated native sequence PRO1028 polypeptide, which in one embodiment, includes an amino acid sequence comprising residues 1 through 197 of FIG. 198 (SEQ ID NO:281). Optionally, the PRO1028 polypeptide is obtained or is obtainable by expressing the polypeptide encoded by the cDNA insert of the vector deposited on Jun. 9, 1998 with the ATCC as DNA59603-1419.

85. PRO1027

A cDNA clone (DNA59605-1418) has been identified, having a type II fibronectin collagen-binding domain that encodes a novel polypeptide, designated in the present application as "PRO1027."

In one embodiment, the invention provides an isolated nucleic acid molecule comprising DNA encoding a PRO1027 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1027 polypeptide having the sequence of amino acid residues from about 1 or 34 to about 77, inclusive of FIG. 200 (SEQ ID NO:283), or (b) the complement of the DNA molecule of (a). The term "or" as used herein to refer to amino or nucleic acids is meant to refer to two alternative embodiments provided herein, i.e., 1–77, or in another embodiment, 34–77.

In another aspect, the invention concerns an isolated nucleic acid molecule encoding a PRO1027 polypeptide comprising DNA hybridizing to the complement of the nucleic acid between about residues 31 or 130 and about 261, inclusive, of FIG. 199 (SEQ ID NO:282). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203005 (DNA59605-1418), or (b) the complement of the DNA molecule of (a). In a preferred embodiment, the nucleic acid comprises a DNA encoding the same mature polypeptide encoded by the human protein cDNA in ATCC Deposit No. 203005 (DNA59605-1418).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 34 to about 77, inclusive of FIG. 200 (SEQ ID NO:283), or the complement of the DNA of (a).

In a further aspect, the invention concerns an isolated nucleic acid molecule produced by hybridizing a test DNA molecule under stringent conditions with (a) a DNA molecule encoding a PRO1027 polypeptide having the sequence of amino acid residues from about 1 or 34 to about 77, inclusive of FIG. 200 (SEQ ID NO:283), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 34 to about 77, inclusive of FIG. 200 (SEQ ID NO:283), or (b) the complement of the DNA of (a).

In another embodiment, the invention provides isolated PRO1027 polypeptide encoded by any of the isolated nucleic acid sequences hereinabove defined.

In a specific aspect, the invention provides isolated native sequence PRO1027 polypeptide, which in one embodiment, includes an amino acid sequence comprising residues 1 or 34 through 77 of FIG. 200 (SEQ ID NO:283).

In another aspect, the invention concerns an isolated PRO1027 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 34 to about 77, inclusive of FIG. 200 (SEQ ID NO:283).

In a further aspect, the invention concerns an isolated PRO1027 polypeptide, comprising an amino acid sequence scoring at least about 80% positives, preferably at least about 85% positives, more preferably at least about 90% positives, most preferably at least about 95% positives when compared with the amino acid sequence of residues 1 or 34 through 77 of FIG. 200 (SEQ ID NO:283).

In a still further aspect, the invention provides a polypeptide produced by (i) hybridizing a test DNA molecule under stringent conditions with (a) a DNA molecule encoding a PRO1027 polypeptide having the sequence of amino acid residues from about 1 or 34 to about 77, inclusive of FIG. 200 (SEQ ID NO:283), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1027 polypeptide. In a particular embodiment, the agonist or antagonist is an anti-PRO1027 antibody.

In a further embodiment, the invention concerns a method of identifying agonists or antagonists of a native PRO1027 polypeptide, by contacting the native PRO1027 polypeptide with a candidate molecule and monitoring a biological activity mediated by said polypeptide.

In a still further embodiment, the invention concerns a composition comprising a PRO1027 polypeptide, or an

86. PRO1107

Applicants have identified a cDNA clone that encodes a novel polypeptide having sequence identity with PC-1, wherein the polypeptide is designated in the present application as "PRO1107".

In one embodiment, the invention provides an isolated nucleic acid molecule comprising DNA encoding a PRO1107 polypeptide. In one aspect, the isolated nucleic acid comprises DNA encoding the PRO1107 polypeptide having amino acid residues 1 through 477 of FIG. 202 (SEQ ID NO:285), or is complementary to such encoding nucleic acid sequence, and remains stably bound to it under at least moderate, and optionally, under high stringency conditions. In other aspects, the isolated nucleic acid comprises DNA encoding the PRO1107 polypeptide having amino acid residues about 23 through 477 of FIG. 202 (SEQ ID NO:285) or amino acids about 1 or 23 through 428±5 of FIG. 202 (SEQ ID NO:285), or is complementary to such encoding nucleic acid sequence, and remains stably bound to it under at least moderate, and optionally, under high stringency conditions. The isolated nucleic acid sequence may comprise the cDNA insert of the DNA59606-1471 vector deposited on Jun. 9, 1998 with the ATCC, which includes the nucleotide sequence encoding PRO1107.

In another embodiment, the invention provides isolated PRO1107 polypeptide. In particular, the invention provides isolated native sequence PRO1107 polypeptide, which in one embodiment, includes an amino acid sequence comprising residues 1 through 477 of FIG. 202 (SEQ ID NO:285). Additional embodiments of the present invention are directed to PRO1107 polypeptides comprising amino acids about 23 through 477 of FIG. 202 (SEQ ID NO:285) or amino acids about 1 or 23 through 428±5 of FIG. 202 (SEQ ID NO:285). Optionally, the PRO1107 polypeptide is obtained or is obtainable by expressing the polypeptide encoded by the cDNA insert of the DNA59606-1471 vector deposited with the ATCC on Jun. 9, 1998.

87. PRO1140

Applicants have identified a cDNA clone, DNA59607-1497, that encodes a novel multi-span transmembrane polypeptide wherein the polypeptide is designated in the present application as "PRO1140".

In one embodiment, the invention provides an isolated nucleic acid molecule comprising DNA encoding a PRO1140 polypeptide.

In one aspect, the isolated nucleic acid comprises DNA having at least about 80% sequence identity, preferably at least about 85% sequence identity, more preferably at least about 90% sequence identity, and most preferably at least about 95% sequence identity to (a) a DNA molecule encoding a PRO1140 polypeptide having the sequence of amino acid residues from 1 to about 255, inclusive of FIG. 204 (SEQ ID NO:287), or (b) the complement of the DNA molecule of (a).

In another aspect, the invention concerns an isolated nucleic acid molecule encoding a PRO1140 polypeptide comprising DNA that hybridizes to the complement of the nucleic acid sequence having about residues 210 to about 974, inclusive of FIG. 203 (SEQ ID NO:286). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, and most preferably at least about 95% sequence identity to (a) a DNA molecule encoding the same mature polypeptide encoded by the human protein cDNA in ATCC Deposit No. 209946 (DNA59607-1497), which was deposited on Jun. 9, 1998, or (b) the complement of the DNA molecule of (a). In a preferred embodiment, the nucleic acid comprises a DNA molecule encoding the same mature polypeptide encoded by the human protein cDNA in ATCC Deposit No. 209946 (DNA59607-1497).

In a still further aspect, the invention concerns an isolated nucleic acid molecule comprising DNA encoding a polypeptide having at least about 80% sequence identity, preferably at least about 85% sequence identity, more preferably at least about 90% sequence identity, and most preferably at least about 95% sequence identity to the sequence of amino acid residues 1 to about 255, inclusive of FIG. 204 (SEQ ID NO:287).

In a specific aspect, the invention provides an isolated nucleic acid molecule comprising DNA encoding a PRO1140 extracellular domain (ECD), with or without the initiating methionine, and its soluble variants (i.e. transmembrane domain(s) deleted or inactivated) or is complementary to such encoding nucleic acid molecule. Referring to the PRO1140 amino acid sequence (SEQ ID NO:287) shown in FIG. 204, transmembrane domain regions have been tentatively identified as extending from about amino acid positions 101 to about 118, about 141 to about 161, and from about 172 to about 191.

In another aspect, the invention concerns an isolated nucleic acid molecule comprising DNA encoding a polypeptide scoring at least about 80% positives, preferably at least about 90% positives, and most preferably at least about 95% positives when compared with the amino acid sequence of residues 1 to about 255, inclusive of FIG. 204 (SEQ ID NO:287).

Another embodiment is directed to fragments of a PRO1140 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1140 polypeptide encoded by any of the isolated nucleic acid sequences hereinabove identified.

In a specific aspect, the invention provides isolated native sequence PRO1140 polypeptide, which in one embodiment, includes an amino acid sequence comprising residues 1 to 255 of FIG. 204 (SEQ ID NO:287).

In another aspect, the invention concerns an isolated PRO1140 polypeptide, comprising an amino acid sequence having at least about 80% sequence identity, preferably at least about 85% sequence identity, more preferably at least about 90% sequence identity, and most preferably at least about 95% sequence identity to the sequence of amino acid residues 1 to 255, inclusive of FIG. 204 (SEQ ID NO:287).

In a further aspect, the invention concerns an isolated PRO1140 polypeptide, comprising an amino acid sequence scoring at least about 80% positives, preferably at least about 85% positives, more preferably at least about 90% positives, and most preferably at least about 95% positives when compared with the amino acid sequence of residues 1 to about 255 of FIG. 204 (SEQ ID NO:287).

In another aspect, the invention concerns a PRO1140 extracellular domain comprising an amino acid sequence having at least about 80% sequence identity, preferably at least about 85% sequence identity, more preferably at least about 90% sequence identity, and most preferably at least about 95% sequence identity to the sequence of amino acid residues 1 to X of FIG. 204 (SEQ ID NO:287), wherein X is any one of amino acid residues 96 to 105 of FIG. 204 (SEQ ID NO:287).

In yet another aspect, the invention concerns an isolated PRO1140 polypeptide, comprising the sequence of amino acid residues 1 to about 255, inclusive of FIG. 204 (SEQ ID NO:287), or a fragment thereof sufficient to provide a binding site for an anti-PRO1140 antibody. Preferably, the PRO1140 fragment retains a qualitative biological activity of a native PRO1140 polypeptide.

In another aspect, the present invention is directed to fragments of a PRO1140 polypeptide which are sufficiently long to provide an epitope against which an antibody may be generated.

88. PRO1106

Applicants have identified a cDNA clone that encodes a novel polypeptide having sequence identity with a peroxisomal calcium-dependent solute carrier, wherein the polypeptide is designated in the present application as "PRO1106".

In one embodiment, the invention provides an isolated nucleic acid molecule comprising DNA encoding a PRO1106 polypeptide. In one aspect, the isolated nucleic acid comprises DNA encoding the PRO1106 polypeptide having amino acid residues 1 through 469 of FIG. 206 (SEQ ID NO:289), or is complementary to such encoding nucleic acid sequence, and remains stably bound to it under at least moderate, and optionally, under high stringency conditions. The isolated nucleic acid sequence may comprise the cDNA insert of the DNA59609-1470 vector deposited on Jun. 9, 1998 with the ATCC, which includes the nucleotide sequence encoding PRO1106.

In another embodiment, the invention provides isolated PRO1106 polypeptide. In particular, the invention provides isolated native sequence PRO1106 polypeptide, which in one embodiment, includes an amino acid sequence comprising residues 1 through 469 of FIG. 206 (SEQ ID NO:289). Optionally, the PRO1106 polypeptide is obtained or is obtainable by expressing the polypeptide encoded by the cDNA insert of the DNA59609-1470 vector deposited with the ATCC on Jun. 9, 1998.

89. PRO1291

A cDNA clone (DNA59610-1556) has been identified, having homology to nucleic acid encoding butyrophilin that encodes a novel polypeptide, designated in the present application as "PRO1291".

In one embodiment, the invention provides an isolated nucleic acid molecule comprising DNA encoding a PRO1291 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1291 polypeptide having the sequence of amino acid residues from about 1 or about 29 to about 282, inclusive of FIG. 208 (SEQ ID NO:291), or (b) the complement of the DNA molecule of (a).

In another aspect, the invention concerns an isolated nucleic acid molecule encoding a PRO1291 polypeptide comprising DNA hybridizing to the complement of the nucleic acid between about nucleotides 61 or about 145 and about 906, inclusive, of FIG. 207 (SEQ ID NO:290). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209990 (DNA59610-1556) or (b) the complement of the nucleic acid molecule of (a). In a preferred embodiment, the nucleic acid comprises a DNA encoding the same mature polypeptide encoded by the human protein cDNA in ATCC Deposit No. 209990 (DNA59610-1556).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 282, inclusive of FIG. 208 (SEQ ID NO:291), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1291 polypeptide having the sequence of amino acid residues from 1 or about 29 to about 282, inclusive of FIG. 208 (SEQ ID NO:291), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1291 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 28 in the sequence of FIG. 208 (SEQ ID NO:291). The transmembrane domain has been tentatively identified as extending from about amino acid position 258 to about amino acid position 281 in the PRO1291 amino acid sequence (FIG. 208, SEQ ID NO:291).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 282, inclusive of FIG. 208 (SEQ ID NO:291), or (b) the complement of the DNA of (a).

Another embodiment is directed to fragments of a PRO1291 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 207 (SEQ ID NO:290).

In another embodiment, the invention provides isolated PRO1291 polypeptide encoded by any of the isolated nucleic acid sequences hereinabove identified.

In a specific aspect, the invention provides isolated native sequence PRO1291 polypeptide, which in certain embodiments, includes an amino acid sequence comprising residues 1 or about 29 to about 282 of FIG. 208 (SEQ ID NO:291).

In another aspect, the invention concerns an isolated PRO1291 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 282, inclusive of FIG. 208 (SEQ ID NO:291).

In a further aspect, the invention concerns an isolated PRO1291 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 282, inclusive of FIG. 208 (SEQ ID NO:291).

In yet another aspect, the invention concerns an isolated PRO1291 polypeptide, comprising the sequence of amino acid residues 1 or about 29 to about 282, inclusive of FIG. 208 (SEQ ID NO:291), or a fragment thereof sufficient to provide a binding site for an anti-PRO1291 antibody. Preferably, the PRO1291 fragment retains a qualitative biological activity of a native PRO1291 polypeptide.

In a still further aspect, the invention provides a polypeptide produced by (i) hybridizing a test DNA molecule under stringent conditions with (a) a DNA molecule encoding a PRO1291 polypeptide having the sequence of amino acid residues from about 1 or about 29 to about 282, inclusive of FIG. 208 (SEQ ID NO:291), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1291 polypeptide. In a particular embodiment, the agonist or antagonist is an anti-PRO1291 antibody.

In a further embodiment, the invention concerns a method of identifying agonists or antagonists of a native PRO1291 polypeptide by contacting the native PRO1291 polypeptide with a candidate molecule and monitoring a biological activity mediated by said polypeptide.

In a still further embodiment, the invention concerns a composition comprising a PRO1291 polypeptide, or an agonist or antagonist as hereinabove defined, in combination with a pharmaceutically acceptable carrier.

90. PRO1105

Applicants have identified a cDNA clone that encodes a novel polypeptide having two transmembrane domains, wherein the polypeptide is designated in the present application as "PRO1105".

In one embodiment, the invention provides an isolated nucleic acid molecule comprising DNA encoding a PRO1105 polypeptide. In one aspect, the isolated nucleic acid comprises DNA encoding the PRO1105 polypeptide having amino acid residues 1 through 180 of FIG. 210 (SEQ ID NO:293), or is complementary to such encoding nucleic acid sequence, and remains stably bound to it under at least moderate, and optionally, under high stringency conditions. In other aspects, the isolated nucleic acid comprises DNA encoding the PRO1105 polypeptide having amino acid residues about 20 through 180 of FIG. 210 (SEQ ID NO:293), or is complementary to such encoding nucleic acid sequence, and remains stably bound to it under at least moderate, and optionally, under high stringency conditions. The isolated nucleic acid sequence may comprise the cDNA insert of the DNA59612-1466 vector deposited on Jun. 9, 1998 with the ATCC, which includes the nucleotide sequence encoding PRO1105.

In another embodiment, the invention provides isolated PRO1105 polypeptide. In particular, the invention provides isolated native sequence PRO1105 polypeptide, which in one embodiment, includes an amino acid sequence comprising residues 1 through 180 of FIG. 210 (SEQ ID NO:293). Additional embodiments of the present invention are directed to PRO1105 polypeptides comprising amino acids about 20 through 180 of FIG. 210 (SEQ ID NO:293). Other embodiments of the present invention are directed to PRO1105 polypeptides comprising amino acids about 1 through 79 and 100 through about 144 of FIG. 210 (SEQ ID NO:293). Optionally, the PRO1105 polypeptide is obtained or is obtainable by expressing the polypeptide encoded by the cDNA insert of the DNA59612-1466 vector deposited with the ATCC on Jun. 9, 1998.

91. PRO511

A cDNA clone (DNA59613-1417) has been identified, having some sequence identity with RoBo-1 and phospholipase inhibitors that encodes a novel polypeptide, designated in the present application as "PRO1026."

In one embodiment, the invention provides an isolated nucleic acid molecule comprising DNA encoding a PRO1026 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1026 polypeptide having the sequence of amino acid residues from about 1 or 26 to about 237, inclusive of FIG. 212 (SEQ ID NO:295), or (b) the complement of the DNA molecule of (a). The term "or" as used herein to refer to amino or nucleic acids is meant to refer to two alternative embodiments provided herein, i.e., 1–237, or in another embodiment, 26–237.

In another aspect, the invention concerns an isolated nucleic acid molecule encoding a PRO1026 polypeptide comprising DNA hybridizing to the complement of the nucleic acid between about residues 233 or 308 and about 943, inclusive, of FIG. 212 (SEQ ID NO:295). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203007 (DNA59613-1417), or (b) the complement of the DNA molecule of (a). In a preferred embodiment, the nucleic acid comprises a DNA encoding the same mature polypeptide encoded by the human protein cDNA in ATCC Deposit No. 203007 (DNA59613-1417).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 26 to about 237, inclusive of FIG. 212 (SEQ ID NO:295), or the complement of the DNA of (a).

In a further aspect, the invention concerns an isolated nucleic acid molecule produced by hybridizing a test DNA molecule under stringent conditions with (a) a DNA molecule encoding a PRO1026 polypeptide having the sequence of amino acid residues from about 1 or 26 to about 237, inclusive of FIG. 212 (SEQ ID NO:295), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 26 to about 237, inclusive of FIG. 212 (SEQ ID NO:295), or (b) the complement of the DNA of (a).

In another embodiment, the invention provides isolated PRO1026 polypeptide encoded by any of the isolated nucleic acid sequences hereinabove defined.

In a specific aspect, the invention provides isolated native sequence PRO1026 polypeptide, which in one embodiment, includes an amino acid sequence comprising residues 1 or 26 through 237 of FIG. 212 (SEQ ID NO:295).

In another aspect, the invention concerns an isolated PRO1026 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 26 to about 237, inclusive of FIG. 212 (SEQ ID NO:295).

In a further aspect, the invention concerns an isolated PRO1026 polypeptide, comprising an amino acid sequence scoring at least about 80% positives, preferably at least about 85% positives, more preferably at least about 90% positives, most preferably at least about 95% positives when compared with the amino acid sequence of residues 1 or 26 through 237 of FIG. 212 (SEQ ID NO:295).

In a still further aspect, the invention provides a polypeptide produced by (i) hybridizing a test DNA molecule under stringent conditions with (a) a DNA molecule encoding a PRO1026 polypeptide having the sequence of amino acid residues from about 1 or 26 to about 237, inclusive of FIG. 212 (SEQ ID NO:295), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1026 polypeptide. In a particular embodiment, the agonist or antagonist is an anti-PRO1026 antibody.

In a further embodiment, the invention concerns a method of identifying agonists or antagonists of a native PRO1026 polypeptide, by contacting the native PRO1026 polypeptide with a candidate molecule and monitoring a biological activity mediated by said polypeptide.

In a still further embodiment, the invention concerns a composition comprising a PRO1026 polypeptide, or an agonist or antagonist as hereinabove defined, in combination with a pharmaceutically acceptable carrier.

92. PRO1104

A cDNA clone (DNA59616-1465) has been identified, that encodes a novel polypeptide, designated in the present application as "PRO1104."

In one embodiment, the invention provides an isolated nucleic acid molecule comprising DNA encoding a PRO1104 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1104 polypeptide having the sequence of amino acid residues from about 1 or about 23 to about 341, inclusive of FIG. 214 (SEQ ID NO:297), or (b) the complement of the DNA molecule of (a). The term "or" as used herein to refer to amino or nucleic acids is meant to refer to two alternative embodiments provided herein, i.e., 1–341, or in another embodiment, 23–341.

In another aspect, the invention concerns an isolated nucleic acid molecule encoding a PRO1104 polypeptide comprising DNA hybridizing to the complement of the nucleic acid between about residues 109 or 175 and about 1131, inclusive, of FIG. 213 (SEQ ID NO:296). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209991 (DNA59616-1465), or (b) the complement of the DNA molecule of (a). In a preferred embodiment, the nucleic acid comprises a DNA encoding the same mature polypeptide encoded by the human protein cDNA in ATCC Deposit No. 209991 (DNA59616-1465).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or about 23 to about 341, inclusive of FIG. 214 (SEQ ID NO:297), or the complement of the DNA of (a).

In a further aspect, the invention concerns an isolated nucleic acid molecule produced by hybridizing a test DNA molecule under stringent conditions with (a) a DNA molecule encoding a PRO1104 polypeptide having the sequence of amino acid residues from about 1 or about 23 to about 341, inclusive of FIG. 214 (SEQ ID NO:297), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 23 to about 341, inclusive of FIG. 214 (SEQ ID NO:297), or (b) the complement of the DNA of (a).

In another embodiment, the invention provides isolated PRO1104 polypeptide encoded by any of the isolated nucleic acid sequences hereinabove defined.

In a specific aspect, the invention provides isolated native sequence PRO1104 polypeptide, which in one embodiment, includes an amino acid sequence comprising residues 1 or about 23 through 341 of FIG. 214 (SEQ ID NO:297).

In another aspect, the invention concerns an isolated PRO1104 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 23 through about 341, inclusive of FIG. 214 (SEQ ID NO:297).

In a further aspect, the invention concerns an isolated PRO1104 polypeptide, comprising an amino acid sequence scoring at least about 80% positives, preferably at least about 85% positives, more preferably at least about 90% positives, most preferably at least about 95% positives when compared with the amino acid sequence of residues 1 or about 23 through 341 of FIG. 214 (SEQ ID NO:297).

In a still further aspect, the invention provides a polypeptide produced by (i) hybridizing a test DNA molecule under stringent conditions with (a) a DNA molecule encoding a PRO1104 polypeptide having the sequence of amino acid residues from about 1 or about 23 to about 341, inclusive of FIG. 214 (SEQ ID NO:297), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

93. PRO1100

A cDNA clone (DNA59619-1464) has been identified that encodes a novel polypeptide having multiple transmembrane domains, designated in the present application as "PRO1100."

In one embodiment, the invention provides an isolated nucleic acid molecule comprising DNA encoding a PRO1100 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1100 polypeptide having the sequence of amino acid residues from about 1 or 21 to about 320, inclusive of FIG. 216 (SEQ ID NO:299), or (b) the complement of the DNA molecule of (a). The term "or" as used herein to refer to amino or nucleic acids is meant to refer to two alternative embodiments provided herein, i.e., 1–320, or in another embodiment, 21–320.

In another aspect, the invention concerns an isolated nucleic acid molecule encoding a PRO1100 polypeptide comprising DNA hybridizing to the complement of the nucleic acid between about residues 33 or 93 and about 992, inclusive, of FIG. 215 (SEQ ID NO:298). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203041 (DNA59619-1464), or (b) the complement of the DNA molecule of (a). In a preferred embodiment, the nucleic acid comprises a DNA encoding the same mature polypeptide encoded by the human protein cDNA in ATCC Deposit No. 203041 (DNA59619-1464).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 21 to about 320, inclusive of FIG. 216 (SEQ ID NO:299), or the complement of the DNA of (a).

In a further aspect, the invention concerns an isolated nucleic acid molecule produced by hybridizing a test DNA molecule under stringent conditions with (a) a DNA molecule encoding a PRO1100 polypeptide having the sequence of amino acid residues from about 1 or 21 to about 320, inclusive of FIG. 216 (SEQ ID NO:299), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1100 polypeptide, with or without the N-terminal signal sequence and/or the initiating methionine, and its soluble, i.e. transmembrane domains deleted or inactivated variants, or is complementary to such encoding nucleic acid molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 21 to about 320, inclusive of FIG. 216 (SEQ ID NO:299), or (b) the complement of the DNA of (a).

In another embodiment, the invention provides isolated PRO1100 polypeptide encoded by any of the isolated nucleic acid sequences hereinabove defined.

In a specific aspect, the invention provides isolated native sequence PRO1100 polypeptide, which in one embodiment, includes an amino acid sequence comprising residues 1 or 21 through 320 of FIG. 216 (SEQ ID NO:299).

In another aspect, the invention concerns an isolated PRO1100 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 21 to about 320, inclusive of FIG. 216 (SEQ ID NO:299).

In a further aspect, the invention concerns an isolated PRO100 polypeptide, comprising an amino acid sequence scoring at least about 80% positives, preferably at least about 85% positives, more preferably at least about 90% positives, most preferably at least about 95% positives when compared with the amino acid sequence of residues 1 or 21 through 320 of FIG. 216 (SEQ ID NO:299).

In a still further aspect, the invention provides a polypeptide produced by (i) hybridizing a test DNA molecule under stringent conditions with (a) a DNA molecule encoding a PRO1100 polypeptide having the sequence of amino acid residues from about 1 or 21 to about 320, inclusive of FIG. 216 (SEQ ID NO:299), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1100 polypeptide. In a particular embodiment, the agonist or antagonist is an anti-PRO1100 antibody.

In a further embodiment, the invention concerns a method of identifying agonists or antagonists of a native PRO1100 polypeptide, by contacting the native PRO1100 polypeptide with a candidate molecule and monitoring a biological activity mediated by said polypeptide.

In a still further embodiment, the invention concerns a composition comprising a PRO1100 polypeptide, or an agonist or antagonist as hereinabove defined, in combination with a pharmaceutically acceptable carrier.

94. PRO836

A cDNA clone (DNA59620-1463) has been identified, having some sequence identity with SLS1 that encodes a novel polypeptide, designated in the present application as "PRO836."

In one embodiment, the invention provides an isolated nucleic acid molecule comprising DNA encoding a PRO836 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO836 polypeptide having the sequence of amino acid residues from about 1 or 30 to about 461, inclusive of FIG. 218 (SEQ ID NO:301), or (b) the complement of the DNA molecule of (a). The term "or" as used herein to refer to amino or nucleic acids is meant to refer to two alternative embodiments provided herein, i.e., 1–461, or in another embodiment, 30–461.

In another aspect, the invention concerns an isolated nucleic acid molecule encoding a PRO836 polypeptide comprising DNA hybridizing to the complement of the nucleic acid between about residues 65 or 152 and about 1447, inclusive, of FIG. 217 (SEQ ID NO:300). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209989 (DNA59620-1463), or (b) the complement of the DNA molecule of (a). In a preferred embodiment, the nucleic acid comprises a DNA encoding the same mature polypeptide encoded by the human protein cDNA in ATCC Deposit No. 209989 (DNA59620-1463).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 30 to about 461, inclusive of FIG. 218 (SEQ ID NO:301), or the complement of the DNA of (a).

In a further aspect, the invention concerns an isolated nucleic acid molecule produced by hybridizing a test DNA molecule under stringent conditions with (a) a DNA molecule encoding a PRO836 polypeptide having the sequence of amino acid residues from about 1 or 30 to about 461, inclusive of FIG. 218 (SEQ ID NO:301), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 30 to about 461, inclusive of FIG. 218 (SEQ ID NO:301), or (b) the complement of the DNA of (a).

In another embodiment, the invention provides isolated PRO836 polypeptide encoded by any of the isolated nucleic acid sequences hereinabove defined.

In a specific aspect, the invention provides isolated native sequence PRO836 polypeptide, which in one embodiment, includes an amino acid sequence comprising residues 1 or 30 through 461 of FIG. 218 (SEQ ID NO:301).

In another aspect, the invention concerns an isolated PRO836 polypeptide, comprising an amino acid sequence having at least about 80% sequence identity, preferably at least about 85% sequence identity, more preferably about 90% sequence identity, most preferably at least about 95% sequence identity to the sequence of amino acid residues 1 or 30 to about 461, inclusive of FIG. 218 (SEQ ID NO:301).

In a further aspect, the invention concerns an isolated PRO836 polypeptide, comprising an amino acid sequence scoring at least about 80% positives, preferably at least about 85% positives, more preferably at least about 90% positives, most preferably at least about 95% positives when compared with the amino acid sequence of residues 1 or 30 through 461 of FIG. 218 (SEQ ID NO:301).

In a still further aspect, the invention provides a polypeptide produced by (i) hybridizing a test DNA molecule under stringent conditions with (a) a DNA molecule encoding a PRO836 polypeptide having the sequence of amino acid residues from about 1 or 30 to about 461, inclusive of FIG. 218 (SEQ ID NO:301), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO836 polypeptide. In a particular embodiment, the agonist or antagonist is an anti-PRO836 antibody.

In a further embodiment, the invention concerns a method of identifying agonists or antagonists of a native PRO836 polypeptide, by contacting the native PRO836 polypeptide with a candidate molecule and monitoring a biological activity mediated by said polypeptide.

In a still further embodiment, the invention concerns a composition comprising a PRO836 polypeptide, or an agonist or antagonist as hereinabove defined, in combination with a pharmaceutically acceptable carrier.

95. PRO1141

A cDNA clone (DNA59625-1498) has been identified that encodes a novel transmembrane polypeptide, designated in the present application as "PRO1141".

In one embodiment, the invention provides an isolated nucleic acid molecule comprising DNA encoding a PRO1141 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1141 polypeptide having the sequence of amino acid residues from about 1 or about 20 to about 247, inclusive of FIG. 220 (SEQ ID NO:303), or (b) the complement of the DNA molecule of (a).

In another aspect, the invention concerns an isolated nucleic acid molecule encoding a PRO1141 polypeptide comprising DNA hybridizing to the complement of the nucleic acid between about nucleotides 204 or about 261 and about 944, inclusive, of FIG. 219 (SEQ ID NO:302). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209992 (DNA59625-1498) or (b) the complement of the nucleic acid molecule of (a). In a preferred embodiment, the nucleic acid comprises a DNA encoding the same mature polypeptide encoded by the human protein cDNA in ATCC Deposit No. 209992 (DNA59625-1498).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 247, inclusive of FIG. 220 (SEQ ID NO:303), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1141 polypeptide having the sequence of amino acid residues from 1 or about 20 to about 247, inclusive of FIG. 220 (SEQ ID NO:303), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1141 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 19 in the sequence of FIG. 220 (SEQ ID NO:303). The transmembrane domains have been tentatively identified as extending from about amino acid position 38 to about amino acid position 57, from about amino acid position 67 to about amino acid position 83, from about amino acid position 117 to about amino acid position 139 and from about amino acid position 153 to about amino acid position 170, in the PRO1141 amino acid sequence (FIG. 220, SEQ ID NO:303).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 247, inclusive of FIG. 220 (SEQ ID NO:303), or (b) the complement of the DNA of (a).

Another embodiment is directed to fragments of a PRO1141 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 219 (SEQ ID NO:302).

In another embodiment, the invention provides isolated PRO1141 polypeptide encoded by any of the isolated nucleic acid sequences hereinabove identified.

In a specific aspect, the invention provides isolated native sequence PRO1141 polypeptide, which in certain embodiments, includes an amino acid sequence comprising residues 1 or about 20 to about 247 of FIG. 220 (SEQ ID NO:303).

In another aspect, the invention concerns an isolated PRO1141 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 247, inclusive of FIG. 220 (SEQ ID NO:303).

In a further aspect, the invention concerns an isolated PRO1141 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 247, inclusive of FIG. 220 (SEQ ID NO:303).

In yet another aspect, the invention concerns an isolated PRO1141 polypeptide, comprising the sequence of amino acid residues 1 or about 20 to about 247, inclusive of FIG. 220 (SEQ ID NO:303), or a fragment thereof sufficient to provide a binding site for an anti-PRO1141 antibody. Preferably, the PRO1141 fragment retains a qualitative biological activity of a native PRO1141 polypeptide.

In a still further aspect, the invention provides a polypeptide produced by (i) hybridizing a test DNA molecule under stringent conditions with (a) a DNA molecule encoding a PRO1141 polypeptide having the sequence of amino acid residues from about 1 or about 20 to about 247, inclusive of FIG. 220 (SEQ ID NO:303), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides an expressed sequence tag (EST) designated herein as DNA33128 comprising the nucleotide sequence of SEQ ID NO:304 (see FIG. 221).

In another embodiment, the invention provides an expressed sequence tag (EST) designated herein as DNA34256 comprising the nucleotide sequence of SEQ ID NO:305 (see FIG. 222).

In another embodiment, the invention provides an expressed sequence tag (EST) designated herein as DNA47941 comprising the nucleotide sequence of SEQ ID NO:306 (see FIG. 223).

In another embodiment, the invention provides an expressed sequence tag (EST) designated herein as DNA54389 comprising the nucleotide sequence of SEQ ID NO:307 (see FIG. 224).

96. PRO1132

A cDNA clone (DNA59767-1489) has been identified that encodes a novel polypeptide having sequence identity with serine proteases and trypsinogen and designated in the present application as "PRO1132."

In one embodiment, the invention provides an isolated nucleic acid molecule comprising DNA encoding a PRO1132 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1132 polypeptide having the sequence of amino acid residues from about 23 to about 293, inclusive of FIG. 226 (SEQ ID NO:309), or (b) the complement of the DNA molecule of (a).

In another aspect, the invention concerns an isolated nucleic acid molecule encoding a PRO1132 polypeptide comprising DNA hybridizing to the complement of the nucleic acid between about residues 420 and about 1232, inclusive, of FIG. 225 (SEQ ID NO:308). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203108 (DNA59767-1489), or (b) the complement of the DNA molecule of (a). In a preferred embodiment, the nucleic acid comprises a DNA encoding the same mature polypeptide encoded by the human protein cDNA in ATCC Deposit No. 203108 (DNA59767-1489).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 23 to about 293, inclusive of FIG. 226 (SEQ ID NO:309), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1132 polypeptide having the sequence of amino acid residues from about 23 to about 293, inclusive of FIG. 226 (SEQ ID NO:309), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 23 to about 293, inclusive of FIG. 226 (SEQ ID NO:309), or (b) the complement of the DNA of (a).

Another embodiment is directed to fragments of a PRO1132 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1132 polypeptide encoded by any of the isolated nucleic acid sequences hereinabove defined.

In a specific aspect, the invention provides isolated native sequence PRO1132 polypeptide, which in one embodiment, includes an amino acid sequence comprising residues 23 through 293 of FIG. 226 (SEQ ID NO:309).

In another aspect, the invention concerns an isolated PRO1132 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 23 to about 293, inclusive of FIG. 226 (SEQ ID NO:309).

In a further aspect, the invention concerns an isolated PRO1132 polypeptide, comprising an amino acid sequence scoring at least about 80% positives, preferably at least about 85% positives, more preferably at least about 90% positives, most preferably at least about 95% positives when compared with the amino acid sequence of residues 23 through 293 of FIG. 226 (SEQ ID NO:309).

In yet another aspect, the invention concerns an isolated PRO1132 polypeptide, comprising the sequence of amino acid residues 23 to about 293, inclusive of FIG. 226 (SEQ ID NO:309), or a fragment thereof sufficient to provide a binding site for an anti-PRO1132 antibody. Preferably, the PRO1132 fragment retains a qualitative biological activity of a native PRO1132 polypeptide.

In a still further aspect, the invention provides a polypeptide produced by (i) hybridizing a test DNA molecule under stringent conditions with (a) a DNA molecule encoding a PRO1132 polypeptide having the sequence of amino acid residues from about 23 to about 293, inclusive of FIG. 226 (SEQ ID NO:309), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1132 polypeptide. In a particular embodiment, the agonist or antagonist is an anti-PRO1132 antibody.

In a further embodiment, the invention concerns a method of identifying agonists or antagonists of a native PRO1132 polypeptide, by contacting the native PRO1132 polypeptide with a candidate molecule and monitoring a biological activity mediated by said polypeptide.

In a still further embodiment, the invention concerns a composition comprising a PRO1132 polypeptide, or an agonist or antagonist as hereinabove defined, in combination with a pharmaceutically acceptable carrier.

97. PRO1346

A cDNA clone (DNA59776-1600) has been identified, that encodes a novel polypeptide, designated in the present application as PRO1346 (or NL7), having homology to known TIE ligands.

In one embodiment, the invention provides an isolated nucleic acid molecule comprising DNA encoding an NL7 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding an NL7 polypeptide having the sequence of amino acid residues from about 51 to about 461, inclusive of FIG. 228 (SEQ ID NO:314), or (b) the complement of the DNA molecule of (a).

In another aspect, the invention concerns an isolated nucleic acid molecule encoding an NL7 polypeptide comprising DNA hybridizing to the complement of the nucleic acid between about nucleotides 1–3 (ATG) and about 1381–1383 (CGC, preceding the TAG stop codon), inclusive, of FIG. 227 (SEQ ID NO:313). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203128 (DNA59776-1600), or (b) the complement of the DNA molecule of (a). In a preferred embodiment, the nucleic acid comprises a DNA encoding the same mature polypeptide encoded by the human protein cDNA in ATCC Deposit No. 203128 (DNA59776-1600).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 51 to about 461, inclusive of FIG. 228 (SEQ ID NO:314), or the complement of the DNA of (a).

In a further aspect, the invention concerns an isolated nucleic acid molecule having at least about 1000 nucleotides and produced by hybridizing a test DNA molecule under stringent conditions with (a) a DNA molecule encoding an NL7 polypeptide having the sequence of amino acid residues from about 51 to about 461, inclusive of FIG. 228 (SEQ ID NO:314), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding an NL7 polypeptide, with or without the initiating methionine, or its soluble forms, i.e. transmembrane domain deleted or inactivated variants, or is complementary to such encoding nucleic acid molecule. The transmembrane domain has been tentatively identified as extending from about amino acid position 31 to about amino acid position 50 in the NL7 amino acid sequence (FIG. 228, SEQ ID NO:314).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 51 to about 461, inclusive of FIG. 228 (SEQ ID NO:314), or (b) the complement of the DNA of (a).

In a further aspect, the invention concerns an isolated nucleic acid molecule, at least about 200 bases in length, which encodes a fragment of a native NL7 polypeptide.

In another embodiment, the invention provides an isolated NL7 polypeptide encoded by any of the isolated nucleic acid sequences hereinabove defined.

In a specific aspect, the invention provides an isolated native sequence NL7 polypeptide, which in one embodiment, includes an amino acid sequence comprising residues from about 51 to about 461 of FIG. 228 (SEQ ID NO:314).

In another aspect, the invention concerns an isolated NL7 polypeptide, comprising an amino acid sequence having at least about 80% sequence identity, preferably at least about 85% sequence identity, more preferably at least about 90% sequence identity, most preferably at least about 95% sequence identity to the sequence of amino acid residues from about 51 to about 461, inclusive of FIG. 228 (SEQ ID NO:314).

In a further aspect, the invention concerns an isolated NL7 polypeptide, comprising an amino acid sequence scoring at least about 80% positives, preferably at least about 85% positives, more preferably at least about 90% positives, most preferably at least about 95% positives when compared with the amino acid sequence of residues 51 to 461 of FIG. 228 (SEQ ID NO:314).

In yet another aspect, the invention concerns an isolated NL7 polypeptide, comprising the sequence of amino acid residues from about 51 to about 461, inclusive of FIG. 228

(SEQ ID NO:314), or a fragment thereof sufficient to provide a binding site for an anti-NL7 antibody. Preferably, the NL7 fragment retains a qualitative biological activity of a native NL7 polypeptide.

In a still further aspect, the invention provides a polypeptide produced by (i) hybridizing a test DNA molecule under stringent conditions with (a) a DNA molecule encoding an NL7 polypeptide having the sequence of amino acid residues from about 51 to about 461, inclusive of FIG. 228 (SEQ ID NO:314), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native NL7 polypeptide. In a particular embodiment, the agonist or antagonist is an anti-NL7 antibody.

In a further embodiment, the invention concerns a method of identifying agonists or antagonists of a native NL7 polypeptide, by contacting the native NL7 polypeptide with a candidate molecule and monitoring a biological activity mediated by said polypeptide.

In a still further embodiment, the invention concerns a composition comprising an NL7 polypeptide, or an agonist or antagonist as hereinabove defined, in combination with a pharmaceutically acceptable carrier.

98. PRO1131

A cDNA clone (DNA59777-1480) has been identified that encodes a novel polypeptide having sequence identity with LDL receptors and designated in the present application as "PRO1131."

In one embodiment, the invention provides an isolated nucleic acid molecule comprising DNA encoding a PRO1131 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1131 polypeptide having the sequence of amino acid residues from about 1 to about 280, inclusive of FIG. 230 (SEQ ID NO:319), or (b) the complement of the DNA molecule of (a).

In another aspect, the invention concerns an isolated nucleic acid molecule encoding a PRO1131 polypeptide comprising DNA hybridizing to the complement of the nucleic acid between about residues 144 and about 983, inclusive, of FIG. 229 (SEQ ID NO:318). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203111 (DNA59777-1480), or (b) the complement of the DNA molecule of (a). In a preferred embodiment, the nucleic acid comprises a DNA encoding the same mature polypeptide encoded by the human protein cDNA in ATCC Deposit No. 203111 (DNA59777-1480).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 280, inclusive of FIG. 230 (SEQ ID NO:319), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1131 polypeptide having the sequence of amino acid residues from about 1 to about 280, inclusive of FIG. 230 (SEQ ID NO:319), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1131 polypeptide in its soluble form, i.e. transmembrane domain deleted or inactivated variants, or is complementary to such encoding nucleic acid molecule. The transmembrane domain (type II) has been tentatively identified as extending from about amino acid positions 49–74 in the amino acid sequence of FIG. 230, SEQ ID NO:319.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 280, inclusive of FIG. 230 (SEQ ID NO:319), or (b) the complement of the DNA of (a).

Another embodiment is directed to fragments of a PRO1131 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1131 polypeptide encoded by any of the isolated nucleic acid sequences hereinabove defined.

In a specific aspect, the invention provides isolated native sequence PRO1131 polypeptide, which in one embodiment, includes an amino acid sequence comprising residues 1 through 280 of FIG. 230 (SEQ ID NO:319).

In another aspect, the invention concerns an isolated PRO1131 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 280, inclusive of FIG. 230 (SEQ ID NO:319).

In a further aspect, the invention concerns an isolated PRO1131 polypeptide, comprising an amino acid sequence scoring at least about 80% positives, preferably at least about 85% positives, more preferably at least about 90% positives, most preferably at least about 95% positives when compared with the amino acid sequence of residues 1 through 280 of FIG. 230 (SEQ ID NO:319).

In yet another aspect, the invention concerns an isolated PRO1131 polypeptide, comprising the sequence of amino acid residues 1 to about 280, inclusive of FIG. 230 (SEQ ID NO:319), or a fragment thereof sufficient to provide a binding site for an anti-PRO1131 antibody. Preferably, the PRO1131 fragment retains a qualitative biological activity of a native PRO1131 polypeptide.

In a still further aspect, the invention provides a polypeptide produced by (i) hybridizing a test DNA molecule under stringent conditions with (a) a DNA molecule encoding a PRO1131 polypeptide having the sequence of amino acid residues from about 1 to about 280, inclusive of FIG. 230 (SEQ ID NO:319), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1131 polypeptide. In a particular embodiment, the agonist or antagonist is an anti-PRO1131 antibody.

In a further embodiment, the invention concerns a method of identifying agonists or antagonists of a native PRO1131 polypeptide, by contacting the native PRO1131 polypeptide with a candidate molecule and monitoring a biological activity mediated by said polypeptide.

In a still further embodiment, the invention concerns a composition comprising a PRO1131 polypeptide, or an agonist or antagonist as hereinabove defined, in combination with a pharmaceutically acceptable carrier.

In another embodiment, the invention provides an expressed sequence tag (EST) designated herein as DNA43546 comprising the nucleotide sequence of FIG. 231 (SEQ ID NO:320).

99. PRO1281

A cDNA clone (DNA59820-1549) has been identified that encodes a novel secreted polypeptide designated in the present application as "PRO1281".

In one embodiment, the invention provides an isolated nucleic acid molecule comprising DNA encoding a PRO1281 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1281 polypeptide having the sequence of amino acid residues from about 16 to about 775, inclusive of FIG. 233 (SEQ ID NO:326), or (b) the complement of the DNA molecule of (a).

In another aspect, the invention concerns an isolated nucleic acid molecule encoding a PRO1281 polypeptide comprising DNA hybridizing to the complement of the nucleic acid between about residues 273 and about 2552, inclusive, of FIG. 232 (SEQ ID NO:325). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203129 (DNA59820-1549), or (b) the complement of the DNA molecule of (a). In a preferred embodiment, the nucleic acid comprises a DNA encoding the same mature polypeptide encoded by the human protein cDNA in ATCC Deposit No. 203129 (DNA59820-1549).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 775, inclusive of FIG. 233 (SEQ ID NO:326), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1281 polypeptide having the sequence of amino acid residues from about 16 to about 775, inclusive of FIG. 233 (SEQ ID NO:326), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1281 polypeptide, with or without the N-terminal signal sequence and/or the initiating methionine, or is complementary to such encoding nucleic acid molecule. The signal peptide has been tentatively identified as extending from amino acid position 1 through about amino acid position 15 in the sequence of FIG. 233 (SEQ ID NO:326).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 775, inclusive of FIG. 233 (SEQ ID NO:326), or (b) the complement of the DNA of (a).

Another embodiment is directed to fragments of a PRO1281 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1281 polypeptide encoded by any of the isolated nucleic acid sequences hereinabove defined.

In a specific aspect, the invention provides isolated native sequence PRO1281 polypeptide, which in one embodiment, includes an amino acid sequence comprising residues 16 to 775 of FIG. 233 (SEQ ID NO:326).

In another aspect, the invention concerns an isolated PRO1281 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 775, inclusive of FIG. 233 (SEQ ID NO:326).

In a further aspect, the invention concerns an isolated PRO1281 polypeptide, comprising an amino acid sequence scoring at least about 80% positives, preferably at least about 85% positives, more preferably at least about 90% positives, most preferably at least about 95% positives when compared with the amino acid sequence of residues 16 to 775 of FIG. 233 (SEQ ID NO:326).

In yet another aspect, the invention concerns an isolated PRO1281 polypeptide, comprising the sequence of amino acid residues 16 to about 775, inclusive of FIG. 233 (SEQ ID NO:326), or a fragment thereof sufficient to provide a binding site for an anti-PRO1281 antibody. Preferably, the PRO1281 fragment retains a qualitative biological activity of a native PRO1281 polypeptide.

In a still further aspect, the invention provides a polypeptide produced by (i) hybridizing a test DNA molecule under stringent conditions with (a) a DNA molecule encoding a PRO1281 polypeptide having the sequence of amino acid residues from about 16 to about 775, inclusive of FIG. 233 (SEQ ID NO:326), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

100. PRO1064

A cDNA clone (DNA59827-1426) has been identified that encodes a novel transmembrane polypeptide, designated in the present application as "PRO1064".

In one embodiment, the invention provides an isolated nucleic acid molecule comprising DNA encoding a PRO1064 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1064 polypeptide having the sequence of amino acid residues from about 1 or about 25 to about 153, inclusive of FIG. 235 (SEQ ID NO:334), or (b) the complement of the DNA molecule of (a).

In another aspect, the invention concerns an isolated nucleic acid molecule encoding a PRO1064 polypeptide comprising DNA hybridizing to the complement of the nucleic acid between about nucleotides 532 or about 604 and about 990, inclusive, of FIG. 234 (SEQ ID NO:333). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203089 (DNA59827-1426) or (b) the complement of the nucleic acid molecule of (a). In a preferred embodiment, the nucleic acid comprises a DNA encoding the same mature polypeptide encoded by the human protein cDNA in ATCC Deposit No. 203089 (DNA59827-1426).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 153, inclusive of FIG. 235 (SEQ ID NO:334), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1064 polypeptide having the sequence of amino acid residues from 1 or about 25 to about 153, inclusive of FIG. 235 (SEQ ID NO:334), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1064 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 24 in the sequence of FIG. 235 (SEQ ID NO:334). The transmembrane domain has been tentatively identified as extending from about amino acid position 89 to about amino acid position 110 in the PRO1064 amino acid sequence (FIG. 235, SEQ ID NO:334).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 25 to about 153, inclusive of FIG. 235 (SEQ ID NO:334), or (b) the complement of the DNA of (a).

Another embodiment is directed to fragments of a PRO1064 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 234 (SEQ ID NO:333).

In another embodiment, the invention provides isolated PRO1064 polypeptide encoded by any of the isolated nucleic acid sequences hereinabove identified.

In a specific aspect, the invention provides isolated native sequence PRO1064 polypeptide, which in certain embodiments, includes an amino acid sequence comprising residues 1 or about 25 to about 153 of FIG. 235 (SEQ ID NO:334).

In another aspect, the invention concerns an isolated PRO1064 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to about 153, inclusive of FIG. 235 (SEQ ID NO:334).

In a further aspect, the invention concerns an isolated PRO1064 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 153, inclusive of FIG. 235 (SEQ ID NO:334).

In yet another aspect, the invention concerns an isolated PRO1064 polypeptide, comprising the sequence of amino acid residues 1 or about 25 to about 153, inclusive of FIG. 235 (SEQ ID NO:334), or a fragment thereof sufficient to provide a binding site for an anti-PRO1064 antibody. Preferably, the PRO1064 fragment retains a qualitative biological activity of a native PRO1064 polypeptide.

In a still further aspect, the invention provides a polypeptide produced by (i) hybridizing a test DNA molecule under stringent conditions with (a) a DNA molecule encoding a PRO1064 polypeptide having the sequence of amino acid residues from about 1 or about 25 to about 153, inclusive of FIG. 235 (SEQ ID NO:334), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In another embodiment, the invention provides an expressed sequence tag (EST) designated herein as DNA45288 comprising the nucleotide sequence of SEQ ID NO:335 (see FIG. 236).

101. PRO1379

A cDNA clone (DNA59828-1608) has been identified that encodes a novel secreted polypeptide designated in the present application as "PRO1379."

In one embodiment, the invention provides an isolated nucleic acid molecule comprising DNA encoding a PRO1379 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1379 polypeptide having the sequence of amino acid residues from about 18 to about 574, inclusive of FIG. 238 (SEQ ID NO:340), or (b) the complement of the DNA molecule of (a).

In another aspect, the invention concerns an isolated nucleic acid molecule encoding a PRO1379 polypeptide comprising DNA hybridizing to the complement of the nucleic acid between about residues 61 and about 1731, inclusive, of FIG. 237 (SEQ ID NO:339). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203158 (DNA59828-1608), or (b) the complement of the DNA molecule of (a). In a preferred embodiment, the nucleic acid comprises a DNA encoding the same mature polypeptide encoded by the human protein cDNA in ATCC Deposit No. 203158 (DNA59828-1608).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 574, inclusive of FIG. 238 (SEQ ID NO:340), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1379 polypeptide having the sequence of amino acid residues from about 18 to about 574, inclusive of FIG. 238 (SEQ ID NO:340), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1379 polypeptide, with or without the N-terminal signal sequence and/or the initiating methionine, or is complementary to such encoding nucleic acid molecule. The signal peptide has been tentatively identified as extending from amino acid position 1 through about amino acid position 17 in the sequence of FIG. 238 (SEQ ID NO:340).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 574, inclusive of FIG. 238 (SEQ ID NO:340), or (b) the complement of the DNA of (a).

Another embodiment is directed to fragments of a PRO1379 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1379 polypeptide encoded by any of the isolated nucleic acid sequences hereinabove defined.

In a specific aspect, the invention provides isolated native sequence PRO1379 polypeptide, which in one embodiment, includes an amino acid sequence comprising residues 18 to 574 of FIG. 238 (SEQ ID NO:340).

In another aspect, the invention concerns an isolated PRO1379 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 574, inclusive of FIG. 238 (SEQ ID NO:340).

In a further aspect, the invention concerns an isolated PRO1379 polypeptide, comprising an amino acid sequence scoring at least about 80% positives, preferably at least about 85% positives, more preferably at least about 90% positives, most preferably at least about 95% positives when compared with the amino acid sequence of residues 18 to 574 of FIG. 238 (SEQ ID NO:340).

In yet another aspect, the invention concerns an isolated PRO1379 polypeptide, comprising the sequence of amino acid residues 18 to about 574, inclusive of FIG. 238 (SEQ ID NO:340), or a fragment thereof sufficient to provide a binding site for an anti-PRO1379 antibody. Preferably, the PRO1379 fragment retains a qualitative biological activity of a native PRO1379 polypeptide.

In a still further aspect, the invention provides a polypeptide produced by (i) hybridizing a test DNA molecule under stringent conditions with (a) a DNA molecule encoding a PRO1379 polypeptide having the sequence of amino acid residues from about 18 to about 574, inclusive of FIG. 238 (SEQ ID NO:340), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

102. PRO844

A cDNA clone (DNA59838-1462) has been identified, having sequence identity with protease inhibitors, that encodes a novel polypeptide, designated in the present application as "PRO844."

In one embodiment, the invention provides an isolated nucleic acid molecule comprising DNA encoding a PRO844 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO844 polypeptide having the sequence of amino acid residues from about 1 or 20 to about 111, inclusive of FIG. 240 (SEQ ID NO:345), or (b) the complement of the DNA molecule of (a). The term "or" as used herein to refer to amino or nucleic acids is meant to refer to two alternative embodiments provided herein, i.e., 1–111, or in another embodiment, 20–111.

In another aspect, the invention concerns an isolated nucleic acid molecule encoding a PRO844 polypeptide comprising DNA hybridizing to the complement of the nucleic acid between about residues 5 or 62 and about 337, inclusive, of FIG. 239 (SEQ ID NO:344). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209976 (DNA59838-1462), or (b) the complement of the DNA molecule of (a). In a preferred embodiment, the nucleic acid comprises a DNA encoding the same mature polypeptide encoded by the human protein cDNA in ATCC Deposit No. 209976 (DNA59838-1462).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 20 to about 111, inclusive of FIG. 240 (SEQ ID NO:345), or the complement of the DNA of (a).

In a further aspect, the invention concerns an isolated nucleic acid molecule produced by hybridizing a test DNA molecule under stringent conditions with (a) a DNA molecule encoding a PRO844 polypeptide having the sequence of amino acid residues from about 1 or 20 to about 111, inclusive of FIG. 240 (SEQ ID NO:345), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 20 to about 111, inclusive of FIG. 240 (SEQ ID NO:345), or (b) the complement of the DNA of (a).

In another embodiment, the invention provides isolated PRO844 polypeptide encoded by any of the isolated nucleic acid sequences hereinabove defined.

In a specific aspect, the invention provides isolated native sequence PRO844 polypeptide, which in one embodiment, includes an amino acid sequence comprising residues 1 or 20 through 111 of FIG. 240 (SEQ ID NO:345).

In another aspect, the invention concerns an isolated PRO844 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 20 to about 111, inclusive of FIG. 240 (SEQ ID NO:345).

In a further aspect, the invention concerns an isolated PRO844 polypeptide, comprising an amino acid sequence scoring at least about 80% positives, preferably at least about 85% positives, more preferably at least about 90% positives, most preferably at least about 95% positives when compared with the amino acid sequence of residues 1 or 20 through 111 of FIG. 240 (SEQ ID NO:345).

In a still further aspect, the invention provides a polypeptide produced by (i) hybridizing a test DNA molecule under stringent conditions with (a) a DNA molecule encoding a PRO844 polypeptide having the sequence of amino acid residues from about 1 or 20 to about 111, inclusive of FIG. 240 (SEQ ID NO:345), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO844 polypeptide. In a particular embodiment, the agonist or antagonist is an anti-PRO844 antibody.

In a further embodiment, the invention concerns a method of identifying agonists or antagonists of a native PRO844 polypeptide, by contacting the native PRO844 polypeptide with a candidate molecule and monitoring a biological activity mediated by said polypeptide.

In a still further embodiment, the invention concerns a composition comprising a PRO844 polypeptide, or an agonist or antagonist as hereinabove defined, in combination with a pharmaceutically acceptable carrier.

103. PRO848

A cDNA clone (DNA59839-1461) has been identified, having sequence identity with sialytransferases that encodes a novel polypeptide, designated in the present application as "PRO848."

In one embodiment, the invention provides an isolated nucleic acid molecule comprising DNA encoding a PRO848 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO848 polypeptide having the sequence of amino acid residues from about 1 or 36 to about 600, inclusive of FIG. 242 (SEQ ID NO:347), or (b) the complement of the DNA molecule of (a). The term "or" as used herein to refer to amino or nucleic acids is meant to refer to two alternative embodiments provided herein, i.e., 1–600, or in another embodiment, 36–600.

In another aspect, the invention concerns an isolated nucleic acid molecule encoding a PRO848 polypeptide comprising DNA hybridizing to the complement of the nucleic acid between about residues 1 or 251 and about 1945, inclusive, of FIG. 241 (SEQ ID NO:346). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209988 (DNA59839-1461), or (b) the complement of the DNA molecule of (a). In a preferred embodiment, the nucleic acid comprises a DNA encoding the same mature polypeptide encoded by the human protein cDNA in ATCC Deposit No. 209988 (DNA59839-1461).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 36 to about 600, inclusive of FIG. 242 (SEQ ID NO:347), or the complement of the DNA of (a).

In a further aspect, the invention concerns an isolated nucleic acid molecule produced by hybridizing a test DNA molecule under stringent conditions with (a) a DNA molecule encoding a PRO848 polypeptide having the sequence of amino acid residues from about 1 or 36 to about 600, inclusive of FIG. 242 (SEQ ID NO:347), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 36 to about 600, inclusive of FIG. 242 (SEQ ID NO:347), or (b) the complement of the DNA of (a).

In another embodiment, the invention provides isolated PRO848 polypeptide encoded by any of the isolated nucleic acid sequences hereinabove defined.

In a specific aspect, the invention provides isolated native sequence PRO848 polypeptide, which in one embodiment, includes an amino acid sequence comprising residues 1 or 36 through 600 of FIG. 242 (SEQ ID NO:347).

In another aspect, the invention concerns an isolated PRO848 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 36 to about 600, inclusive of FIG. 242 (SEQ ID NO:347).

In a further aspect, the invention concerns an isolated PRO848 polypeptide, comprising an amino acid sequence scoring at least about 80% positives, preferably at least about 85% positives, more preferably at least about 90% positives, most preferably at least about 95% positives when compared with the amino acid sequence of residues 1 or 36 through 600 of FIG. 242 (SEQ ID NO:347).

In a still further aspect, the invention provides a polypeptide produced by (i) hybridizing a test DNA molecule under stringent conditions with (a) a DNA molecule encoding a PRO848 polypeptide having the sequence of amino acid residues from about 1 or 36 to about 600, inclusive of FIG. 242 (SEQ ID NO:347), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO848 polypeptide. In a particular embodiment, the agonist or antagonist is an anti-PRO848 antibody.

In a further embodiment, the invention concerns a method of identifying agonists or antagonists of a native PRO848 polypeptide, by contacting the native PRO848 polypeptide with a candidate molecule and monitoring a biological activity mediated by said polypeptide.

In a still further embodiment, the invention concerns a composition comprising a PRO848 polypeptide, or an agonist or antagonist as hereinabove defined, in combination with a pharmaceutically acceptable carrier.

104. PRO1097

Applicants have identified a cDNA clone (DNA59841-1460) that encodes a novel secreted polypeptide having domains therein from the glycoprotease family proteins and the acyltransferase ChoActase/COT/CPT family, wherein the polypeptide is designated in the present application as "PRO1097".

In one embodiment, the invention provides an isolated nucleic acid molecule comprising DNA encoding a PRO1097 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1097 polypeptide having the sequence of amino acid residues from about 1 or 21 to about 91, inclusive of FIG. 244 (SEQ ID NO:349), or (b) the complement of the DNA molecule of (a). The term "or" as used herein to refer to amino or nucleic acids is meant to refer to two alternative embodiments provided herein, i.e., 1–91, or in another embodiment, 21–91.

In another aspect, the invention concerns an isolated nucleic acid molecule encoding a PRO1097 polypeptide comprising DNA hybridizing to the complement of the nucleic acid between about residues 3 or 63 and about 275, inclusive, of FIG. 243 (SEQ ID NO:348). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203044 (DNA59841-1460), or (b) the complement of the DNA molecule of (a). In a preferred embodiment, the nucleic acid comprises a DNA encoding the same mature polypeptide encoded by the human protein cDNA in ATCC Deposit No. 203044 (DNA59841-1460).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 21 to about 91, inclusive of FIG. 244 (SEQ ID NO:349), or the complement of the DNA of (a).

In a further aspect, the invention concerns an isolated nucleic acid molecule produced by hybridizing a test DNA molecule under stringent conditions with (a) a DNA molecule encoding a PRO1097 polypeptide having the sequence of amino acid residues from about 1 or 21 to about 91, inclusive of FIG. 244 (SEQ ID NO:349), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1097 polypeptide, with or without the N-terminal signal sequence and/or the initiating methionine. The signal peptide has been tentatively identified as extending from amino acid position 1 through about amino acid position 20 in the sequence of FIG. 244 (SEQ ID NO:349).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 21 to about 91, inclusive of FIG. 244 (SEQ ID NO:349), or (b) the complement of the DNA of (a).

In another embodiment, the invention provides isolated PRO1097 polypeptide encoded by any of the isolated nucleic acid sequences hereinabove defined.

In a specific aspect, the invention provides isolated native sequence PRO1097 polypeptide, which in one embodiment, includes an amino acid sequence comprising residues 1 or 21 through 91 of FIG. 244 (SEQ ID NO:349).

In another aspect, the invention concerns an isolated PRO1097 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 21 to about 91, inclusive of FIG. 244 (SEQ ID NO:349).

In a further aspect, the invention concerns an isolated PRO1097 polypeptide, comprising an amino acid sequence scoring at least about 80% positives, preferably at least about 85% positives, more preferably at least about 90% positives, most preferably at least about 95% positives when compared with the amino acid sequence of residues 1 or 21 through 91 of FIG. 244 (SEQ ID NO:349).

In a still further aspect, the invention provides a polypeptide produced by (i) hybridizing a test DNA molecule under stringent conditions with (a) a DNA molecule encoding a PRO1097 polypeptide having the sequence of amino acid residues from about 1 or 21 to about 91, inclusive of FIG. 244 (SEQ ID NO:349), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1097 polypeptide. In a particular embodiment, the agonist or antagonist is an anti-PRO1097 antibody.

In a further embodiment, the invention concerns a method of identifying agonists or antagonists of a native PRO1097 polypeptide, by contacting the native PRO1097 polypeptide with a candidate molecule and monitoring a biological activity mediated by said polypeptide.

In a still further embodiment, the invention concerns a composition comprising a PRO1097 polypeptide, or an agonist or antagonist as hereinabove defined, in combination with a pharmaceutically acceptable carrier.

105. PRO1153

A cDNA clone (DNA59842-1502) has been identified, having two transmembrane domains and being very proline rich, that encodes a novel polypeptide, designated in the present application as "PRO1153."

In one embodiment, the invention provides an isolated nucleic acid molecule comprising DNA encoding a PRO1153 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1153 polypeptide having the sequence of amino acid residues from about 1 to about 197, inclusive of FIG. 246 (SEQ ID NO:351), or (b) the complement of the DNA molecule of (a).

In another aspect, the invention concerns an isolated nucleic acid molecule encoding a PRO1153 polypeptide comprising DNA hybridizing to the complement of the nucleic acid between about residues 92 and about 682, inclusive, of FIG. 245 (SEQ ID NO:350). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209982 (DNA59842-1502), or (b) the complement of the DNA molecule of (a). In a preferred embodiment, the nucleic acid comprises a DNA encoding the same mature polypeptide encoded by the human protein cDNA in ATCC Deposit No. 209982 (DNA59842-1502).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 197, inclusive of FIG. 246 (SEQ ID NO:351), or the complement of the DNA of (a).

In a further aspect, the invention concerns an isolated nucleic acid molecule produced by hybridizing a test DNA molecule under stringent conditions with (a) a DNA molecule encoding a PRO1153 polypeptide having the sequence of amino acid residues from about 1 to about 197, inclusive of FIG. 246 (SEQ ID NO:351), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1153 polypeptide, and its soluble, i.e. transmembrane domain deleted or inactivated variants, or is complementary to such encoding nucleic acid molecule. The transmembrane domains have been tentatively identified as extending from about amino acid positions 10–28 and 85–110 in the PRO1153 amino acid sequence (FIG. 246, SEQ ID NO:351).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 197, inclusive of FIG. 246 (SEQ ID NO:351), or (b) the complement of the DNA of (a).

In another embodiment, the invention provides isolated PRO1153 polypeptide encoded by any of the isolated nucleic acid sequences hereinabove defined.

In a specific aspect, the invention provides isolated native sequence PRO1153 polypeptide, which in one embodiment, includes an amino acid sequence comprising residues 1 to 197 of FIG. 246 (SEQ ID NO:351).

In another aspect, the invention concerns an isolated PRO1153 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 197, inclusive of FIG. 246 (SEQ ID NO:351).

In a further aspect, the invention concerns an isolated PRO1153 polypeptide, comprising an amino acid sequence scoring at least about 80% positives, preferably at least about 85% positives, more preferably at least about 90% positives, most preferably at least about 95% positives when compared with the amino acid sequence of residues 1 through 197 of FIG. 246 (SEQ ID NO:351).

In a still further aspect, the invention provides a polypeptide produced by (i) hybridizing a test DNA molecule under stringent conditions with (a) a DNA molecule encoding a PRO1153 polypeptide having the sequence of amino acid residues from about 1 to about 197, inclusive of FIG. 246 (SEQ ID NO:351), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

106. PRO1154

A cDNA clone (DNA59846-1503) has been identified that encodes a novel aminopeptidase, designated in the present application as "PRO1154."

In one embodiment, the invention provides an isolated nucleic acid molecule comprising DNA encoding a PRO1154 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1154 polypeptide having the sequence of amino acid residues from about 1 or 35 to about 941, inclusive of FIG. 248 (SEQ ID NO:353), or (b) the complement of the DNA molecule of (a).

In another aspect, the invention concerns an isolated nucleic acid molecule encoding a PRO1154 polypeptide comprising DNA hybridizing to the complement of the nucleic acid between about residues 86 or 188 and about 2908, inclusive, of FIG. 247 (SEQ ID NO:352). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209978 (DNA59846-1503), or (b) the complement of the DNA molecule of (a). In a preferred embodiment, the nucleic acid comprises a DNA encoding the same mature polypeptide encoded by the human protein cDNA in ATCC Deposit No. 209978 (DNA59846-1503).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 35 to about 941, inclusive of FIG. 248 (SEQ ID NO:353), or the complement of the DNA of (a).

In a further aspect, the invention concerns an isolated nucleic acid molecule produced by hybridizing a test DNA molecule under stringent conditions with (a) a DNA molecule encoding a PRO1154 polypeptide having the sequence of amino acid residues from about 1 or 35 to about 941, inclusive of FIG. 258 (SEQ ID NO:353), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 35 to about 941, inclusive of FIG. 248 (SEQ ID NO:353), or (b) the complement of the DNA of (a).

In another aspect, the invention concerns an isolated nucleic acid molecule consisting essentially of DNA encoding a polypeptide having amino acids 1 or 35 through about 73 of SEQ ID NO:353.

In another embodiment, the invention provides isolated PRO1154 polypeptide encoded by any of the isolated nucleic acid sequences hereinabove defined.

In a specific aspect, the invention provides isolated native sequence PRO1154 polypeptide, which in one embodiment, includes an amino acid sequence comprising residues 1 or 35 to 941 of FIG. 248 (SEQ ID NO:353).

In a specific aspect, the invention provides a polypeptide having amino acids 1 or 35 through about 73 of SEQ ID NO:353.

In another aspect, the invention concerns an isolated PRO1154 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 35 to about 941, inclusive of FIG. 248 (SEQ ID NO:353).

In a further aspect, the invention concerns an isolated PRO1154 polypeptide, comprising an amino acid sequence scoring at least about 80% positives, preferably at least about 85% positives, more preferably at least about 90% positives, most preferably at least about 95% positives when compared with the amino acid sequence of residues 1 or 35 through 941 of FIG. 248 (SEQ ID NO:353).

In yet another aspect, the invention concerns an isolated PRO1154 polypeptide, comprising the sequence of amino acid residues 1 or 35 to about 941, inclusive of FIG. 248 (SEQ ID NO:353), or a fragment thereof sufficient to provide a binding site for an anti-PRO1154 antibody. Preferably, the PRO1154 fragment retains a qualitative biological activity of a native PRO1154 polypeptide.

In a still further aspect, the invention provides a polypeptide produced by (i) hybridizing a test DNA molecule under stringent conditions with (a) a DNA molecule encoding a PRO1154 polypeptide having the sequence of amino acid residues from about 1 or 35 to about 941, inclusive of FIG. 248 (SEQ ID NO:353), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1154 polypeptide. In a particular embodiment, the agonist or antagonist is an anti-PRO1154 antibody.

In a further embodiment, the invention concerns a method of identifying agonists or antagonists of a native PRO1154 polypeptide, by contacting the native PRO1154 polypeptide with a candidate molecule and monitoring a biological activity mediated by said polypeptide.

In a still further embodiment, the invention concerns a composition comprising a PRO1154 polypeptide, or an agonist or antagonist as hereinabove defined, in combination with a pharmaceutically acceptable carrier.

107. PRO1181

A cDNA clone (DNA59847-1511) has been identified that encodes a novel secreted polypeptide, designated in the present application as "PRO1181."

In one embodiment, the invention provides an isolated nucleic acid molecule comprising DNA encoding a PRO1181 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1181 polypeptide having the sequence of amino acid residues from about 1 or about 16 to about 437, inclusive of FIG. 250 (SEQ ID NO:355), or (b) the complement of the DNA molecule of (a).

In another aspect, the invention concerns an isolated nucleic acid molecule encoding a PRO1181 polypeptide comprising DNA hybridizing to the complement of the nucleic acid between about nucleotides 17 or about 62 and about 1327, inclusive, of FIG. 249 (SEQ ID NO:354). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203098 (DNA59847-1511) or (b) the complement of the nucleic acid molecule of (a). In a preferred embodiment, the nucleic acid comprises a DNA encoding the same mature polypeptide encoded by the human protein cDNA in ATCC Deposit No. 203098 (DNA59847-1511).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 437, inclusive of FIG. 250 (SEQ ID NO:355), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1181 polypeptide having the sequence of amino acid residues from 1 or about 16 to about 437, inclusive of FIG. 250 (SEQ ID NO:355), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1181 polypeptide, with or without the N-terminal signal sequence and/or the initiating methionine or is complementary to such encoding nucleic acid molecule. The signal peptide has been tentatively identified as extending from about amino acid position 1 to about amino acid position 15 in the sequence of FIG. 250 (SEQ ID NO:355). The transmembrane domain is at amino acids positions 243–260 of FIG. 250.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 437, inclusive of FIG. 250 (SEQ ID NO:355), or (b) the complement of the DNA of (a).

Another embodiment is directed to fragments of a PRO1181 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 249 (SEQ ID NO:354).

In another embodiment, the invention provides isolated PRO1181 polypeptide encoded by any of the isolated nucleic acid sequences hereinabove identified.

In a specific aspect, the invention provides isolated native sequence PRO1181 polypeptide, which in certain embodiments, includes an amino acid sequence comprising residues 1 or about 16 to about 437 of FIG. 250 (SEQ ID NO:355).

In another aspect, the invention concerns an isolated PRO1181 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 437, inclusive of FIG. 250 (SEQ ID NO:355).

In a further aspect, the invention concerns an isolated PRO1181 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 437, inclusive of FIG. 250 (SEQ ID NO:355).

In yet another aspect, the invention concerns an isolated PRO1181 polypeptide, comprising the sequence of amino acid residues 1 or about 16 to about 437, inclusive of FIG. 250 (SEQ ID NO:355), or a fragment thereof sufficient to provide a binding site for an anti-PRO1181 antibody. Preferably, the PRO1181 fragment retains a qualitative biological activity of a native PRO1181 polypeptide.

In a still further aspect, the invention provides a polypeptide produced by (i) hybridizing a test DNA molecule under stringent conditions with (a) a DNA molecule encoding a PRO1181 polypeptide having the sequence of amino acid residues from about 1 or about 16 to about 437, inclusive of FIG. 250 (SEQ ID NO:355), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

108. PRO1182

A cDNA clone (DNA59848-1512) has been identified, having homology to nucleic acid encoding conglutinin that encodes a novel polypeptide, designated in the present application as "PRO1182".

In one embodiment, the invention provides an isolated nucleic acid molecule comprising DNA encoding a PRO1182 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1182 polypeptide having the sequence of amino acid residues from about 1 or about 26 to about 271, inclusive of FIG. 252 (SEQ ID NO:357), or (b) the complement of the DNA molecule of (a).

In another aspect, the invention concerns an isolated nucleic acid molecule encoding a PRO1182 polypeptide comprising DNA hybridizing to the complement of the nucleic acid between about nucleotides 67 or about 142 and about 879, inclusive, of FIG. 251 (SEQ ID NO:356). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203088 (DNA59848-1512) or (b) the complement of the nucleic acid molecule of (a). In a preferred embodiment, the nucleic acid comprises a DNA encoding the same mature polypeptide encoded by the human protein cDNA in ATCC Deposit No. 203088 (DNA59848-1512).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 271, inclusive of FIG. 252 (SEQ ID NO:357), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1182 polypeptide having the sequence of amino acid residues from 1 or about 26 to about 271, inclusive of FIG. 252 (SEQ ID NO:357), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1182 polypeptide, with or without the N-terminal signal sequence and/or the initiating methionine or is complementary to such encoding nucleic acid molecule. The signal peptide has been tentatively identified as extending from about amino acid position 1 to about amino acid position 25 in the sequence of FIG. 252 (SEQ ID NO:357).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 271, inclusive of FIG. 252 (SEQ ID NO:357), or (b) the complement of the DNA of (a).

Another embodiment is directed to fragments of a PRO1182 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 251 (SEQ ID NO:356).

In another embodiment, the invention provides isolated PRO1182 polypeptide encoded by any of the isolated nucleic acid sequences hereinabove identified.

In a specific aspect, the invention provides isolated native sequence PRO1182 polypeptide, which in certain embodiments, includes an amino acid sequence comprising residues 1 or about 26 to about 271 of FIG. 252 (SEQ ID NO:357).

In another aspect, the invention concerns an isolated PRO1182 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 271, inclusive of FIG. 252 (SEQ ID NO:357).

In a further aspect, the invention concerns an isolated PRO1182 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 271, inclusive of FIG. 252 (SEQ ID NO:357).

In yet another aspect, the invention concerns an isolated PRO1182 polypeptide, comprising the sequence of amino acid residues 1 or about 26 to about 271, inclusive of FIG. 252 (SEQ ID NO:357), or a fragment thereof sufficient to provide a binding site for an anti-PRO1182 antibody. Preferably, the PRO1182 fragment retains a qualitative biological activity of a native PRO1182 polypeptide.

In a still further aspect, the invention provides a polypeptide produced by (i) hybridizing a test DNA molecule under stringent conditions with (a) a DNA molecule encoding a PRO1182 polypeptide having the sequence of amino acid residues from about 1 or about 26 to about 271, inclusive of FIG. 252 (SEQ ID NO:357), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1182 polypeptide. In a particular embodiment, the agonist or antagonist is an anti-PRO1182 antibody.

In a further embodiment, the invention concerns a method of identifying agonists or antagonists of a native PRO1182 polypeptide by contacting the native PRO1182 polypeptide with a candidate molecule and monitoring a biological activity mediated by said polypeptide.

In a still further embodiment, the invention concerns a composition comprising a PRO1182 polypeptide, or an agonist or antagonist as hereinabove defined, in combination with a pharmaceutically acceptable carrier.

109. PRO1155

A cDNA clone (DNA59849-1504) has been identified, having sequence identity with neurokinin B that encodes a novel polypeptide, designated in the present application as "PRO1155."

In one embodiment, the invention provides an isolated nucleic acid molecule comprising DNA encoding a PRO1155 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1155 polypeptide having the sequence of amino acid residues from about 1 or 19 to about 135, inclusive of FIG. 254 (SEQ ID NO:359), or (b) the complement of the DNA molecule of (a). The term "or" as used herein to refer to nucleic or amino acids is meant to convey alternative embodiments, i.e., 1–135 or alternatively in another embodiment, 19–135.

In another aspect, the invention concerns an isolated nucleic acid molecule encoding a PRO1155 polypeptide comprising DNA hybridizing to the complement of the nucleic acid between about residues 158 or 212 and about 562, inclusive, of FIG. 253 (SEQ ID NO:358). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209986 (DNA59849-1504), or (b) the complement of the DNA molecule of (a). In a preferred embodiment, the nucleic acid comprises a DNA encoding the same mature polypeptide encoded by the human protein cDNA in ATCC Deposit No. 209986 (DNA59849-1504).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 19 to about 135, inclusive of FIG. 254 (SEQ ID NO:359), or the complement of the DNA of (a).

In a further aspect, the invention concerns an isolated nucleic acid molecule produced by hybridizing a test DNA molecule under stringent conditions with (a) a DNA molecule encoding a PRO1155 polypeptide having the sequence of amino acid residues from about 19 to about 135, inclusive of FIG. 254 (SEQ ID NO:359), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 19 to about 135, inclusive of FIG. 254 (SEQ ID NO:359), or (b) the complement of the DNA of (a).

In another embodiment, the invention provides isolated PRO1155 polypeptide encoded by any of the isolated nucleic acid sequences hereinabove defined.

In a specific aspect, the invention provides isolated native sequence PRO1155 polypeptide, which in one embodiment, includes an amino acid sequence comprising residues 1 or 19 through 135 of FIG. 254 (SEQ ID NO:359).

In another aspect, the invention concerns an isolated PRO1155 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 19 to about 135, inclusive of FIG. 254 (SEQ ID NO:359).

In a further aspect, the invention concerns an isolated PRO1155 polypeptide, comprising an amino acid sequence scoring at least about 80% positives, preferably at least about 85% positives, more preferably at least about 90% positives, most preferably at least about 95% positives when compared with the amino acid sequence of residues 1 or 19 through 135 of FIG. 254 (SEQ ID NO:359).

In a still further aspect, the invention provides a polypeptide produced by (i) hybridizing a test DNA molecule under stringent conditions with (a) a DNA molecule encoding a PRO1155 polypeptide having the sequence of amino acid residues from about 1 or 19 to about 135, inclusive of FIG. 254 (SEQ ID NO:359), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1155 polypeptide. In a particular embodiment, the agonist or antagonist is an anti-PRO1155 antibody.

In a further embodiment, the invention concerns a method of identifying agonists or antagonists of a native PRO1155 polypeptide, by contacting the native PRO1155 polypeptide with a candidate molecule and monitoring a biological activity mediated by said polypeptide.

In a still further embodiment, the invention concerns a composition comprising a PRO1155 polypeptide, or an agonist or antagonist as hereinabove defined, in combination with a pharmaceutically acceptable carrier.

110. PRO1156

A cDNA clone (DNA59853-1505) has been identified that encodes a novel secreted polypeptide, designated in the present application as "PRO1156."

In one embodiment, the invention provides an isolated nucleic acid molecule comprising DNA encoding a PRO1156 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1156 polypeptide having the sequence of amino acid residues from about 23 to about 159, inclusive of FIG. 256 (SEQ ID NO:361), or (b) the complement of the DNA molecule of (a).

In another aspect, the invention concerns an isolated nucleic acid molecule encoding a PRO1156 polypeptide comprising DNA hybridizing to the complement of the nucleic acid between about residues 281 and about 688, inclusive, of FIG. 255 (SEQ ID NO:360). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209985 (DNA59853-1505), or (b) the complement of the DNA molecule of (a). In a preferred embodiment, the nucleic acid comprises a DNA encoding the same mature polypeptide encoded by the human protein cDNA in ATCC Deposit No. 209985 (DNA59853-1505).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 23 to about 159, inclusive of FIG. 256 (SEQ ID NO:361), or the complement of the DNA of (a).

In a further aspect, the invention concerns an isolated nucleic acid molecule having at least 50 nucleotides, preferably at least 100 nucleotides, and produced by hybridizing a test DNA molecule under stringent conditions with (a) a DNA molecule encoding a PRO1156 polypeptide having the sequence of amino acid residues from about 23 to about 159, inclusive of FIG. 256 (SEQ ID NO:361), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1156 polypeptide, with or without the N-terminal signal sequence and/or the initiating methionine, or is complementary to such encoding nucleic acid molecule. The signal peptide has been tentatively identified as extending from amino acid position 1 to about amino acid position 22 in the sequence of FIG. 256 (SEQ ID NO:361).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 23 to about 159, inclusive of FIG. 256 (SEQ ID NO:361), or (b) the complement of the DNA of (a).

In another aspect, the invention concerns hybridization probes that comprise fragments of the PRO784 coding sequence, or complementary sequence thereof. The hybridization probes preferably have at least about 20 nucleotides to about 80 nucleotides, and more preferably, at least about 20 to about 50 nucleotides.

In another embodiment, the invention provides isolated PRO1156 polypeptide encoded by any of the isolated nucleic acid sequences hereinabove defined.

In a specific aspect, the invention provides isolated native sequence PRO1156 polypeptide, which in one embodiment, includes an amino acid sequence comprising residues 23 to 159 of FIG. 256 (SEQ ID NO:361).

In another aspect, the invention concerns an isolated PRO1156 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 23 to about 159, inclusive of FIG. 256 (SEQ ID NO:361).

In a further aspect, the invention concerns an isolated PRO1156 polypeptide, comprising an amino acid sequence scoring at least about 80% positives, preferably at least about 85% positives, more preferably at least about 90% positives, most preferably at least about 95% positives when compared with the amino acid sequence of residues 23 to 159 of FIG. 256 (SEQ ID NO:361).

In yet another aspect, the invention concerns an isolated PRO1156 polypeptide, comprising the sequence of amino acid residues 23 to about 159, inclusive of FIG. 256 (SEQ ID NO:361), or a fragment thereof sufficient to provide a binding site for an anti-PRO1156 antibody. Preferably, the PRO1156 fragment retains a qualitative biological activity of a native PRO1156 polypeptide.

In a still further aspect, the invention provides a polypeptide produced by (i) hybridizing a test DNA molecule under stringent conditions with (a) a DNA molecule encoding a PRO1156 polypeptide having the sequence of amino acid residues from about 23 to about 159, inclusive of FIG. 256 (SEQ ID NO:361), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

111. PRO1098

A cDNA clone (DNA59854-1459) has been identified which encodes a novel polypeptide, designated in the present application as "PRO1098."

In one embodiment, the invention provides an isolated nucleic acid molecule comprising DNA encoding a PRO1098 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1098 polypeptide having the sequence of amino acid residues from about 1 or 20 to about 78, inclusive of FIG. 258 (SEQ ID NO:363), or (b) the complement of the DNA molecule of (a). The term "or" as used herein to refer to amino or nucleic acids is meant to refer to two alternative embodiments provided herein, i.e., 1–78, or in another embodiment, 20–78.

In another aspect, the invention concerns an isolated nucleic acid molecule encoding a PRO1098 polypeptide comprising DNA hybridizing to the complement of the nucleic acid between about residues 58 or 115 and about 291, inclusive, of FIG. 257 (SEQ ID NO:362). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209974 (DNA59854-1459), or (b) the complement of the DNA molecule of (a). In a preferred embodiment, the nucleic acid comprises a DNA encoding the same mature polypeptide encoded by the human protein cDNA in ATCC Deposit No. 209974 (DNA59854-1459).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 20 to about 78, inclusive of FIG. 258 (SEQ ID NO:363), or the complement of the DNA of (a).

In a further aspect, the invention concerns an isolated nucleic acid molecule produced by hybridizing a test DNA molecule under stringent conditions with (a) a DNA molecule encoding a PRO1098 polypeptide having the sequence of amino acid residues from about 1 or 20 to about 78, inclusive of FIG. 258 (SEQ ID NO:363), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 20 to about 78, inclusive of FIG. 258 (SEQ ID NO:363), or (b) the complement of the DNA of (a).

In another embodiment, the invention provides isolated PRO1098 polypeptide encoded by any of the isolated nucleic acid sequences hereinabove defined.

In a specific aspect, the invention provides isolated native sequence PRO1098 polypeptide, which in one embodiment, includes an amino acid sequence comprising residues 1 or 20 through 78 of FIG. 258 (SEQ ID NO:363).

In another aspect, the invention concerns an isolated PRO1098 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 20 to about 78, inclusive of FIG. 258 (SEQ ID NO:363).

In a further aspect, the invention concerns an isolated PRO1098 polypeptide, comprising an amino acid sequence scoring at least about 80% positives, preferably at least about 85% positives, more preferably at least about 90% positives, most preferably at least about 95% positives when compared with the amino acid sequence of residues 1 or 20 through 78 of FIG. 258 (SEQ ID NO:363).

In a still further aspect, the invention provides a polypeptide produced by (i) hybridizing a test DNA molecule under stringent conditions with (a) a DNA molecule encoding a PRO1098 polypeptide having the sequence of amino acid residues from about 1 or 20 to about 78, inclusive of FIG. 258 (SEQ ID NO:363), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

112. PRO1127

A cDNA clone (DNA60283-1484) has been identified that encodes a novel secreted polypeptide, designated in the present application as "PRO127."

In one embodiment, the invention provides an isolated nucleic acid molecule comprising DNA encoding a PRO1127 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1127 polypeptide having the sequence of amino acid residues from about 1 or 30 to about 67, inclusive of FIG. 260 (SEQ ID NO:365), or (b) the complement of the DNA molecule of (a). The term "or" in reference to amino or nucleic acids as used herein refers to two alternative embodiments, i.e., 1–67 in one embodiment, or alternatively, 30–67.

In another aspect, the invention concerns an isolated nucleic acid molecule encoding a PRO1127 polypeptide comprising DNA hybridizing to the complement of the nucleic acid between about residues 126 or 213 and about 326, inclusive, of FIG. 259 (SEQ ID NO:364). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203043 (DNA60283-1484), or (b) the complement of the DNA molecule of (a). In a preferred embodiment, the nucleic acid comprises a DNA encoding the same mature polypeptide encoded by the human protein cDNA in ATCC Deposit No. 203043 (DNA60283-1484).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 30 to about 67, inclusive of FIG. 260 (SEQ ID NO:365), or the complement of the DNA of (a).

In a further aspect, the invention concerns an isolated nucleic acid molecule produced by hybridizing a test DNA molecule under stringent conditions with (a) a DNA molecule encoding a PRO1127 polypeptide having the sequence of amino acid residues from about 1 or 30 to about 67, inclusive of FIG. 260 (SEQ ID NO:365), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1127 polypeptide without the N-terminal signal sequence and/or the initiating methionine. The signal peptide has been tentatively identified as extending from amino acid position 1 through about amino acid position 29 in the sequence of FIG. 260 (SEQ ID NO:365).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 30 to about 67, inclusive of FIG. 260 (SEQ ID NO:365), or (b) the complement of the DNA of (a).

Another embodiment is directed to fragments of a PRO1127 polypeptide coding sequence that may find use as hybridization probes. Such nucleic acid fragments are from about 20 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO1127 polypeptide encoded by any of the isolated nucleic acid sequences hereinabove defined.

In a specific aspect, the invention provides isolated native sequence PRO1127 polypeptide, which in one embodiment, includes an amino acid sequence comprising residues 1 or 30 through 67 of FIG. 260 (SEQ ID NO:365).

In another aspect, the invention concerns an isolated PRO1127 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 30 to about 67, inclusive of FIG. 260 (SEQ ID NO:365).

In a further aspect, the invention concerns an isolated PRO1127 polypeptide, comprising an amino acid sequence scoring at least about 80% positives, preferably at least about 85% positives, more preferably at least about 90% positives, most preferably at least about 95% positives when compared with the amino acid sequence of residues 1 or 30 through 67 of FIG. 260 (SEQ ID NO:365).

In a still further aspect, the invention provides a polypeptide produced by (i) hybridizing a test DNA molecule under stringent conditions with (a) a DNA molecule encoding a PRO1127 polypeptide having the sequence of amino acid residues from about 1 or 30 to about 67, inclusive of FIG. 260 (SEQ ID NO:365), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1127 polypeptide. In a particular embodiment, the agonist or antagonist is an anti-PRO1127 antibody.

In a further embodiment, the invention concerns a method of identifying agonists or antagonists of a native PRO1127 polypeptide, by contacting the native PRO1127 polypeptide with a candidate molecule and monitoring a biological activity mediated by said polypeptide.

In a still further embodiment, the invention concerns a composition comprising a PRO1127 polypeptide, or an agonist or antagonist as hereinabove defined, in combination with a pharmaceutically acceptable carrier.

113. PRO1126

A cDNA clone (DNA60615-1483) has been identified, having homology to nucleic acid encoding olfactomedin that encodes a novel polypeptide, designated in the present application as "PRO1126".

In one embodiment, the invention provides an isolated nucleic acid molecule comprising DNA encoding a PRO1126 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1126 polypeptide having the sequence of amino acid residues from about 1 or about 26 to about 402, inclusive of FIG. 262 (SEQ ID NO:367), or (b) the complement of the DNA molecule of (a).

In another aspect, the invention concerns an isolated nucleic acid molecule encoding a PRO1126 polypeptide comprising DNA hybridizing to the complement of the nucleic acid between about nucleotides 110 or about 185 and about 1315, inclusive, of FIG. 261 (SEQ ID NO:366). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209980 (DNA60615-1483) or (b) the complement of the nucleic acid molecule of (a). In a preferred embodiment, the nucleic acid comprises a DNA encoding the same mature polypeptide encoded by the human protein cDNA in ATCC Deposit No. 209980 (DNA60615-1483).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 402, inclusive of FIG. 262 (SEQ ID NO:367), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1126 polypeptide having the sequence of amino acid residues from 1 or about 26 to about 402, inclusive of FIG. 262 (SEQ ID NO:367), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1126 polypeptide, with or without the N-terminal signal sequence and/or the initiating methionine, or is complementary to such encoding nucleic acid molecule. The signal peptide has been tentatively identified as extending from about amino acid position 1 to about amino acid position 25 in the sequence of FIG. 262 (SEQ ID NO:367).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 402, inclusive of FIG. 262 (SEQ ID NO:367), or (b) the complement of the DNA of (a).

Another embodiment is directed to fragments of a PRO1126 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 261 (SEQ ID NO:366).

In another embodiment, the invention provides isolated PRO1126 polypeptide encoded by any of the isolated nucleic acid sequences hereinabove identified.

In a specific aspect, the invention provides isolated native sequence PRO1126 polypeptide, which in certain embodiments, includes an amino acid sequence comprising residues 1 or about 26 to about 402 of FIG. 262 (SEQ ID NO:367).

In another aspect, the invention concerns an isolated PRO1126 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 402, inclusive of FIG. 262 (SEQ ID NO:367).

In a further aspect, the invention concerns an isolated PRO1126 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 402, inclusive of FIG. 262 (SEQ ID NO:367).

In yet another aspect, the invention concerns an isolated PRO1126 polypeptide, comprising the sequence of amino acid residues 1 or about 26 to about 402, inclusive of FIG. 262 (SEQ ID NO:367), or a fragment thereof sufficient to provide a binding site for an anti-PRO1126 antibody. Preferably, the PRO1126 fragment retains a qualitative biological activity of a native PRO1126 polypeptide.

In a still further aspect, the invention provides a polypeptide produced by (i) hybridizing a test DNA molecule under stringent conditions with (a) a DNA molecule encoding a PRO1126 polypeptide having the sequence of amino acid residues from about 1 or about 26 to about 402, inclusive of FIG. 262 (SEQ ID NO:367), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1126 polypeptide. In a particular embodiment, the agonist or antagonist is an anti-PRO1126 antibody.

In a further embodiment, the invention concerns a method of identifying agonists or antagonists of a native PRO1126 polypeptide by contacting the native PRO1126 polypeptide with a candidate molecule and monitoring a biological activity mediated by said polypeptide.

In a still further embodiment, the invention concerns a composition comprising a PRO1126 polypeptide, or an agonist or antagonist as hereinabove defined, in combination with a pharmaceutically acceptable carrier.

114. PRO1125

A cDNA clone (DNA60619-1482) has been identified, having beta-transducin family Trp-Asp (WD) conserved regions, that encodes a novel polypeptide, designated in the present application as "PRO1125."

In one embodiment, the invention provides an isolated nucleic acid molecule comprising DNA encoding a PRO1125 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1125 polypeptide having the sequence of amino acid residues from about 1 or 26 to about 447, inclusive of FIG. 264 (SEQ ID NO:369), or (b) the complement of the DNA molecule of (a). As used herein, "or" when referring to nucleic acids or amino acids, refers to two alternative embodiments, i.e., 1–447 and 26–447.

In another aspect, the invention concerns an isolated nucleic acid molecule encoding a PRO1125 polypeptide comprising DNA hybridizing to the complement of the nucleic acid between about residues 47 or 122 and about 1387, inclusive, of FIG. 263 (SEQ ID NO:368). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209993 (DNA60619-1482), or (b) the complement of the DNA molecule of (a). In a preferred embodiment, the nucleic acid comprises a DNA encoding the same mature polypeptide encoded by the human protein cDNA in ATCC Deposit No. 209993 (DNA60619-1482).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 26 to about 447, inclusive of FIG. 264 (SEQ ID NO:369), or the complement of the DNA of (a).

In a further aspect, the invention concerns an isolated nucleic acid molecule produced by hybridizing a test DNA molecule under stringent conditions with (a) a DNA molecule encoding a PRO1125 polypeptide having the sequence of amino acid residues from about 1 or 26 to about 447, inclusive of FIG. 264 (SEQ ID NO:369), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1125 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 25 in the sequence of FIG. 264 (SEQ ID NO:369).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 26 to about 447, inclusive of FIG. 264 (SEQ ID NO:369), or (b) the complement of the DNA of (a).

In another embodiment, the invention provides isolated PRO1125 polypeptide encoded by any of the isolated nucleic acid sequences hereinabove defined.

In a specific aspect, the invention provides isolated native sequence PRO1125 polypeptide, which in one embodiment, includes an amino acid sequence comprising residues 1 or 26 to 447 of FIG. 264 (SEQ ID NO:369).

In another aspect, the invention concerns an isolated PRO1125 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 26 to about 447, inclusive of FIG. 264 (SEQ ID NO:369).

In a further aspect, the invention concerns an isolated PRO1125 polypeptide, comprising an amino acid sequence scoring at least about 80% positives, preferably at least about 85% positives, more preferably at least about 90% positives, most preferably at least about 95% positives when compared with the amino acid sequence of residues 1 or 26 through 447 of FIG. 264 (SEQ ID NO:369).

In yet another aspect, the invention concerns an isolated PRO1125 polypeptide, comprising the sequence of amino acid residues 26 to about 447, inclusive of FIG. 264 (SEQ ID NO:369), or a fragment thereof sufficient to provide a binding site for an anti-PRO1125 antibody. Preferably, the PRO1125 fragment retains a qualitative biological activity of a native PRO1125 polypeptide.

In a still further aspect, the invention provides a polypeptide produced by (i) hybridizing a test DNA molecule under stringent conditions with (a) a DNA molecule encoding a PRO1125 polypeptide having the sequence of amino acid residues from about 26 to about 447, inclusive of FIG. 264

(SEQ ID NO:369), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1125 polypeptide. In a particular embodiment, the agonist or antagonist is an anti-PRO1125 antibody.

In a further embodiment, the invention concerns a method of identifying agonists or antagonists of a native PRO1125 polypeptide, by contacting the native PRO1125 polypeptide with a candidate molecule and monitoring a biological activity mediated by said polypeptide.

115. PRO1186

A cDNA clone (DNA60621-1516) has been identified that encodes a novel polypeptide having sequence identity with venom protein A and designated in the present application as "PRO1186."

In one embodiment, the invention provides an isolated nucleic acid molecule comprising DNA encoding a PRO1186 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1186 polypeptide having the sequence of amino acid residues from about 20 to about 105, inclusive of FIG. 266 (SEQ ID NO:371), or (b) the complement of the DNA molecule of (a).

In another aspect, the invention concerns an isolated nucleic acid molecule encoding a PRO1186 polypeptide comprising DNA hybridizing to the complement of the nucleic acid between about residues 148 and about 405, inclusive, of FIG. 265 (SEQ ID NO:370). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203091 (DNA60621-1516), or (b) the complement of the DNA molecule of (a). In a preferred embodiment, the nucleic acid comprises a DNA encoding the same mature polypeptide encoded by the human protein cDNA in ATCC Deposit No. 203091 (DNA60621-1516).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 105, inclusive of FIG. 266 (SEQ ID NO:371), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1186 polypeptide having the sequence of amino acid residues from about 20 to about 105, inclusive of FIG. 266 (SEQ ID NO:371), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 105, inclusive of FIG. 266 (SEQ ID NO:371), or (b) the complement of the DNA of (a).

Another embodiment is directed to fragments of a PRO1186 polypeptide coding sequence that may find use as hybridization probes. Such nucleic acid fragments are from about 20 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO1186 polypeptide encoded by any of the isolated nucleic acid sequences hereinabove defined.

In a specific aspect, the invention provides isolated native sequence PRO1186 polypeptide, which in one embodiment, includes an amino acid sequence comprising residues 20 through 105 of FIG. 266 (SEQ ID NO:371).

In another aspect, the invention concerns an isolated PRO1186 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 105, inclusive of FIG. 266 (SEQ ID NO:371).

In a further aspect, the invention concerns an isolated PRO1186 polypeptide, comprising an amino acid sequence scoring at least about 80% positives, preferably at least about 85% positives, more preferably at least about 90% positives, most preferably at least about 95% positives when compared with the amino acid sequence of residues 20 through 105 of FIG. 266 (SEQ ID NO:371).

In yet another aspect, the invention concerns an isolated PRO1186 polypeptide, comprising the sequence of amino acid residues 20 to about 105, inclusive of FIG. 266 (SEQ ID NO:371), or a fragment thereof sufficient to provide a binding site for an anti-PRO1186 antibody. Preferably, the PRO1186 fragment retains a qualitative biological activity of a native PRO1186 polypeptide.

In a still further aspect, the invention provides a polypeptide produced by (i) hybridizing a test DNA molecule under stringent conditions with (a) a DNA molecule encoding a PRO1186 polypeptide having the sequence of amino acid residues from about 20 to about 105, inclusive of FIG. 266 (SEQ ID NO:371), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1186 polypeptide. In a particular embodiment, the agonist or antagonist is an anti-PRO1186 antibody.

In a further embodiment, the invention concerns a method of identifying agonists or antagonists of a native PRO1186 polypeptide, by contacting the native PRO1186 polypeptide with a candidate molecule and monitoring a biological activity mediated by said polypeptide.

In a still further embodiment, the invention concerns a composition comprising a PRO1186 polypeptide, or an agonist or antagonist as hereinabove defined, in combination with a pharmaceutically acceptable carrier.

116. PRO1198

A cDNA clone (DNA60622-1525) has been identified that encodes a novel secreted polypeptide designated in the present application as "PRO1198."

In one embodiment, the invention provides an isolated nucleic acid molecule comprising DNA encoding a PRO1198 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1198 polypeptide having the sequence of amino acid residues from about 35 to about 229, inclusive of FIG. 268 (SEQ ID NO:373), or (b) the complement of the DNA molecule of (a).

In another aspect, the invention concerns an isolated nucleic acid molecule encoding a PRO1198 polypeptide comprising DNA hybridizing to the complement of the nucleic acid between about residues 156 and about 740, inclusive, of FIG. 268 (SEQ ID NO:373). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203090 (DNA60622-1525), or (b) the complement of the DNA molecule of (a). In a preferred embodiment, the nucleic acid comprises a DNA encoding the same mature polypeptide encoded by the human protein cDNA in ATCC Deposit No. 203090 (DNA60622-1525).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 35 to about 229, inclusive of FIG. 268 (SEQ ID NO:373), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1198 polypeptide having the sequence of amino acid residues from about 35 to about 229, inclusive of FIG. 268 (SEQ ID NO:373), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1198 polypeptide, with or without the N-terminal signal sequence and/or the initiating methionine, or is complementary to such encoding nucleic acid molecule. The signal peptide has been tentatively identified as extending from about amino acid position 1 through about amino acid position 35 in the sequence of FIG. 268 (SEQ ID NO:373).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 35 to about 229, inclusive of FIG. 268 (SEQ ID NO:373), or (b) the complement of the DNA of (a).

Another embodiment is directed to fragments of a PRO1198 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1198 polypeptide encoded by any of the isolated nucleic acid sequences hereinabove defined.

In a specific aspect, the invention provides isolated native sequence PRO1198 polypeptide, which in one embodiment, includes an amino acid sequence comprising residues 35 to 229 of FIG. 268 (SEQ ID NO:373).

In another aspect, the invention concerns an isolated PRO1198 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 35 to about 229, inclusive of FIG. 268 (SEQ ID NO:373).

In a further aspect, the invention concerns an isolated PRO1198 polypeptide, comprising an amino acid sequence scoring at least about 80% positives, preferably at least about 85% positives, more preferably at least about 90% positives, most preferably at least about 95% positives when compared with the amino acid sequence of residues 35 to 229 of FIG. 268 (SEQ ID NO:373).

In yet another aspect, the invention concerns an isolated PRO1198 polypeptide, comprising the sequence of amino acid residues 35 to about 229, inclusive of FIG. 268 (SEQ ID NO:373), or a fragment thereof sufficient to provide a binding site for an anti-PRO1198 antibody. Preferably, the PRO1198 fragment retains a qualitative biological activity of a native PRO1198 polypeptide.

In a still further aspect, the invention provides a polypeptide produced by (i) hybridizing a test DNA molecule under stringent conditions with (a) a DNA molecule encoding a PRO1198 polypeptide having the sequence of amino acid residues from about 35 to about 229, inclusive of FIG. 268 (SEQ ID NO:373), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

117. PRO1158

A cDNA clone (DNA60625-1507) has been identified that encodes a novel transmembrane polypeptide, designated in the present application as "PRO1158".

In one embodiment, the invention provides an isolated nucleic acid molecule comprising DNA encoding a PRO1158 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1158 polypeptide having the sequence of amino acid residues from about 20 to about 123, inclusive of FIG. 270 (SEQ ID NO:375), or (b) the complement of the DNA molecule of (a).

In another aspect, the invention concerns an isolated nucleic acid molecule encoding a PRO1158 polypeptide comprising DNA hybridizing to the complement of the nucleic acid between about residues 220 and about 531, inclusive, of FIG. 269 (SEQ ID NO:374). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No.209975 (DNA60625-1507), or (b) the complement of the DNA molecule of (a). In a preferred embodiment, the nucleic acid comprises a DNA encoding the same mature polypeptide encoded by the human protein cDNA in ATCC Deposit No. 209975 (DNA60625-1507).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 123, inclusive of FIG. 270 (SEQ ID NO:375), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1158 polypeptide having the sequence of amino acid residues from about 20 to about 123, inclusive of FIG. 270 (SEQ ID NO:375), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1158 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from about amino acid position 1 to about amino acid position 19 in the sequence of FIG. 270 (SEQ ID NO:375). The transmembrane domain has been tentatively identified as extending from about amino acid position 56 to about amino acid position 80 in the PRO1158 amino acid sequence (FIG. 270, SEQ ID NO:375).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 123, inclusive of FIG. 270 (SEQ ID NO:375), or (b) the complement of the DNA of (a).

In another aspect, the invention concerns hybridization probes that comprise fragments of the PRO1158 coding sequence, or complementary sequence thereof. The hybridization probes preferably have at least about 20 nucleotides to about 80 nucleotides, and more preferably, at least about 20 to about 50 nucleotides.

In another embodiment, the invention provides isolated PRO1158 polypeptide encoded by any of the isolated nucleic acid sequences hereinabove defined.

In a specific aspect, the invention provides isolated native sequence PRO1158 polypeptide, which in one embodiment, includes an amino acid sequence comprising residues 20 to 123 of FIG. 270 (SEQ ID NO:375).

In another aspect, the invention concerns an isolated PRO1158 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 123, inclusive of FIG. 270 (SEQ ID NO:375).

In a further aspect, the invention concerns an isolated PRO1158 polypeptide, comprising an amino acid sequence scoring at least about 80% positives, preferably at least about 85% positives, more preferably at least about 90% positives, most preferably at least about 95% positives when compared with the amino acid sequence of residues 20 to 123 of FIG. 270 (SEQ ID NO:375).

In yet another aspect, the invention concerns an isolated PRO1158 polypeptide, comprising the sequence of amino acid residues 20 to about 123, inclusive of FIG. 270 (SEQ ID NO:375), or a fragment thereof sufficient to provide a binding site for an anti-PRO1158 antibody. Preferably, the PRO1158 fragment retains a qualitative biological activity of a native PRO1158 polypeptide.

In a still further aspect, the invention provides a polypeptide produced by (i) hybridizing a test DNA molecule under stringent conditions with (a) a DNA molecule encoding a PRO1158 polypeptide having the sequence of amino acid residues from about 20 to about 123, inclusive of FIG. 270 (SEQ ID NO:375), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

118. PRO1159

A cDNA clone (DNA60627-1508) has been identified that encodes a novel secreted polypeptide, designated in the present application as "PRO1159".

In one embodiment, the invention provides an isolated nucleic acid molecule comprising DNA encoding a PRO1159 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1159 polypeptide having the sequence of amino acid residues from about 1 or about 16 to about 90, inclusive of FIG. 272 (SEQ ID NO:377), or (b) the complement of the DNA molecule of (a).

In another aspect, the invention concerns an isolated nucleic acid molecule encoding a PRO1159 polypeptide comprising DNA hybridizing to the complement of the nucleic acid between about nucleotides 92 or about 137 and about 361, inclusive, of FIG. 271 (SEQ ID NO:376). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203092 (DNA60627-1508) or (b) the complement of the nucleic acid molecule of (a). In a preferred embodiment, the nucleic acid comprises a DNA encoding the same mature polypeptide encoded by the human protein cDNA in ATCC Deposit No. 203092 (DNA60627-1508).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 90, inclusive of FIG. 272 (SEQ ID NO:377), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1159 polypeptide having the sequence of amino acid residues from 1 or about 16 to about 90, inclusive of FIG. 272 (SEQ ID NO:377), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1159 polypeptide, with or without the N-terminal signal sequence and/or the initiating methionine, or is complementary to such encoding nucleic acid molecule. The signal peptide has been tentatively identified as extending from about amino acid position 1 to about amino acid position 15 in the sequence of FIG. 272 (SEQ ID NO:377).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 90, inclusive of FIG. 272 (SEQ ID NO:377), or (b) the complement of the DNA of (a).

Another embodiment is directed to fragments of a PRO1159 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 271 (SEQ ID NO:376).

In another embodiment, the invention provides isolated PRO1159 polypeptide encoded by any of the isolated nucleic acid sequences hereinabove identified.

In a specific aspect, the invention provides isolated native sequence PRO1159 polypeptide, which in certain embodiments, includes an amino acid sequence comprising residues 1 or about 16 to about 90 of FIG. 272 (SEQ ID NO:377).

In another aspect, the invention concerns an isolated PRO1159 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 90, inclusive of FIG. 272 (SEQ ID NO:377).

In a further aspect, the invention concerns an isolated PRO1159 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 90, inclusive of FIG. 272 (SEQ ID NO:377).

In yet another aspect, the invention concerns an isolated PRO1159 polypeptide, comprising the sequence of amino acid residues 1 or about 16 to about 90, inclusive of FIG. 272 (SEQ ID NO:377), or a fragment thereof sufficient to provide a binding site for an anti-PRO1159 antibody. Preferably, the PRO1159 fragment retains a qualitative biological activity of a native PRO1159 polypeptide.

In a still further aspect, the invention provides a polypeptide produced by (i) hybridizing a test DNA molecule under stringent conditions with (a) a DNA molecule encoding a PRO1159 polypeptide having the sequence of amino acid residues from about 1 or about 16 to about 90, inclusive of FIG. 272 (SEQ ID NO:377), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

119. PRO1124

A cDNA clone (DNA60629-1481) has been identified, having sequence identity with a chloride channel protein and lung-endothelial cell adhesion molecule-1 (EAM-1) that encodes a novel polypeptide, designated in the present application as "PRO1124."

In one embodiment, the invention provides an isolated nucleic acid molecule comprising DNA encoding a PRO1124 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1124 polypeptide having the sequence of amino acid residues from about 1 or 22 to about 919, inclusive of FIG. 274 (SEQ ID NO:379), or (b) the complement of the DNA molecule of (a). As used herein, "or", i.e., 1 or 22 and 25 or 88, is used to describe two alternative embodiments. For example, the invention includes amino acids 1 through 919 and in an alternative embodiment, provides amino acids 22 through 919, etc.

In another aspect, the invention concerns an isolated nucleic acid molecule encoding a PRO1124 polypeptide comprising DNA hybridizing to the complement of the nucleic acid between about residues 25 or 88 and about 2781, inclusive, of FIG. 273 (SEQ ID NO:378). In another aspect, the invention concerns an isolated nucleic acid molecule hybridizing to the complement of the nucleic acid of SEQ ID NO:378. Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 209979 (DNA60629-1481), or (b) the complement of the DNA molecule of (a). In a preferred embodiment, the nucleic acid comprises a DNA encoding the same mature polypeptide encoded by the human protein cDNA in ATCC Deposit No. 209979 (DNA60629-1481).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or 22 to about 919, inclusive of FIG. 274 (SEQ ID NO:379), or the complement of the DNA of (a).

In a specific aspect, the invention provides an isolated nucleic acid molecule comprising DNA encoding a PRO1124 polypeptide, with or without the N-terminal signal sequence and/or the initiating methionine, and its soluble, i.e. transmembrane domain deleted or inactivated variants, or is complementary to such encoding nucleic acid molecule. The cytoplasmic end can be excluded as well. The signal peptide has been tentatively identified as extending from amino acid position 1 to about amino acid position 21 in the sequence of FIG. 274 (SEQ ID NO:379). The transmembrane domains have been tentatively identified as extending from about amino acid position 284 to about amino acid position 300 and from about amino acid position 617 to about amino acid position 633 in the amino acid sequence (FIG. 274, SEQ ID NO:379).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or 22 to about 919, inclusive of FIG. 274 (SEQ ID NO:379), or (b) the complement of the DNA of (a).

In another embodiment, the invention provides isolated PRO1124 polypeptide encoded by any of the isolated nucleic acid sequences hereinabove defined.

In a specific aspect, the invention provides isolated native sequence PRO1124 polypeptide, which in one embodiment, includes an amino acid sequence comprising residues 1 or 22 through 919 of FIG. 274 (SEQ ID NO:379).

In another aspect, the invention concerns an isolated PRO1124 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or 22 to about 919, inclusive of FIG. 274 (SEQ ID NO:379).

In a further aspect, the invention concerns an isolated PRO1124 polypeptide, comprising an amino acid sequence scoring at least about 80% positives, preferably at least about 85% positives, more preferably at least about 90% positives, most preferably at least about 95% positives when compared with the amino acid sequence of residues 1 or 22 to 919 of FIG. 274 (SEQ ID NO:379).

In a still further aspect, the invention provides a polypeptide produced by (i) hybridizing a test DNA molecule under stringent conditions with (a) a DNA molecule encoding a PRO1124 polypeptide having the sequence of amino acid residues from about 1 or 22 to about 919, inclusive of FIG. 274 (SEQ ID NO:379), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1124 polypeptide. In a particular embodiment, the agonist or antagonist is an anti-PRO1124 antibody.

In a further embodiment, the invention concerns a method of identifying agonists or antagonists of a native PRO1124 polypeptide, by contacting the native PRO1124 polypeptide with a candidate molecule and monitoring an activity mediated by said polypeptide.

In a still further embodiment, the invention concerns a composition comprising a PRO1124 polypeptide, or an agonist or antagonist as hereinabove defined, in combination with a pharmaceutically acceptable carrier.

120. PRO1287

A cDNA clone (DNA61755-1554) has been identified, having homology to nucleic acid encoding fringe protein, that encodes a novel polypeptide, designated in the present application as "PRO1287".

In one embodiment, the invention provides an isolated nucleic acid molecule comprising DNA encoding a PRO1287 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1287 polypeptide having the sequence of amino acid residues from about 1 or about 28 to about 532, inclusive of FIG. 276 (SEQ ID NO:381), or (b) the complement of the DNA molecule of (a).

In another aspect, the invention concerns an isolated nucleic acid molecule encoding a PRO1287 polypeptide comprising DNA hybridizing to the complement of the nucleic acid between about nucleotides 655 or about 736 and about 2250, inclusive, of FIG. 275 (SEQ ID NO:380). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203112 (DNA61755-1554) or (b) the complement of the nucleic acid molecule of (a). In a preferred embodiment, the nucleic acid comprises a DNA encoding the same mature polypeptide encoded by the human protein cDNA in ATCC Deposit No. 203112 (DNA61755-1554).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 28 to about 532, inclusive of FIG. 276 (SEQ ID NO:381), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1287 polypeptide having the sequence of amino acid residues from 1 or about 28 to about 532, inclusive of FIG. 276 (SEQ ID NO:381), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1287 polypeptide, with or without the N-terminal signal sequence and/or the initiating methionine, or is complementary to such encoding nucleic acid molecule. The signal peptide has been tentatively identified as extending from about amino acid position 1 to about amino acid position 27 in the sequence of FIG. 276 (SEQ ID NO:381).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 28 to about 532, inclusive of FIG. 276 (SEQ ID NO:381), or (b) the complement of the DNA of (a).

Another embodiment is directed to fragments of a PRO1287 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 275 (SEQ ID NO:380).

In another embodiment, the invention provides isolated PRO1287 polypeptide encoded by any of the isolated nucleic acid sequences hereinabove identified.

In a specific aspect, the invention provides isolated native sequence PRO1287 polypeptide, which in certain embodiments, includes an amino acid sequence comprising residues 1 or about 28 to about 532 of FIG. 276 (SEQ ID NO:381).

In another aspect, the invention concerns an isolated PRO1287 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 28 to about 532, inclusive of FIG. 276 (SEQ ID NO:381).

In a further aspect, the invention concerns an isolated PRO1287 polypeptide, comprising an amino acid sequence scoring at least about 80% positives, preferably at least about 85% positives, more preferably at least about 90% positives, most preferably at least about 95% positives when compared with the amino acid sequence of residues 1 or about 28 to about 532, inclusive of FIG. 276 (SEQ ID NO:381).

In yet another aspect, the invention concerns an isolated PRO1287 polypeptide, comprising the sequence of amino acid residues 1 or about 28 to about 532, inclusive of FIG. 276 (SEQ ID NO:381), or a fragment thereof sufficient to provide a binding site for an anti-PRO1287 antibody. Preferably, the PRO1287 fragment retains a qualitative biological activity of a native PRO1287 polypeptide.

In a still further aspect, the invention provides a polypeptide produced by (i) hybridizing a test DNA molecule under stringent conditions with (a) a DNA molecule encoding a PRO1287 polypeptide having the sequence of amino acid residues from about 1 or about 28 to about 532, inclusive of FIG. 276 (SEQ ID NO:381), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1287 polypeptide. In a particular embodiment, the agonist or antagonist is an anti-PRO1287 antibody.

In a further embodiment, the invention concerns a method of identifying agonists or antagonists of a native PRO1287 polypeptide by contacting the native PRO1287 polypeptide with a candidate molecule and monitoring a biological activity mediated by said polypeptide.

In a still further embodiment, the invention concerns a composition comprising a PRO1287 polypeptide, or an agonist or antagonist as hereinabove defined, in combination with a pharmaceutically acceptable carrier.

121. PRO1312

A cDNA clone (DNA61873-1574) has been identified that encodes a novel transmembrane polypeptide designated in the present application as "PRO1312".

In one embodiment, the invention provides an isolated nucleic acid molecule comprising DNA encoding a PRO1312 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1312 polypeptide having the sequence of amino acid residues from about 15 to about 212, inclusive of FIG. 278 (SEQ ID NO:387), or (b) the complement of the DNA molecule of (a).

In another aspect, the invention concerns an isolated nucleic acid molecule encoding a PRO1312 polypeptide comprising DNA hybridizing to the complement of the nucleic acid between about residues 49 and about 642, inclusive, of FIG. 277 (SEQ ID NO:386). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203132 (DNA61873-1574), or (b) the complement of the DNA molecule of (a). In a preferred embodiment, the nucleic acid comprises a DNA encoding the same mature polypeptide encoded by the human protein cDNA in ATCC Deposit No. 203132 (DNA61873-1574).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 15 to about 212, inclusive of FIG. 278 (SEQ ID NO:387), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1312 polypeptide having the sequence of amino acid residues from about 15 to about 212, inclusive of FIG. 278 (SEQ ID NO:387), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1312 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 14 in the sequence of FIG. 278 (SEQ ID NO:387). The transmembrane domain has been tentatively identified as extending from about amino acid position 141 to about amino acid position 160 in the PRO1312 amino acid sequence (FIG. 278, SEQ ID NO:387).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 15 to about 212, inclusive of FIG. 278 (SEQ ID NO:387), or (b) the complement of the DNA of (a).

Another embodiment is directed to fragments of a PRO1312 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1312 polypeptide encoded by any of the isolated nucleic acid sequences hereinabove defined.

In a specific aspect, the invention provides isolated native sequence PRO1312 polypeptide, which in one embodiment, includes an amino acid sequence comprising residues 15 to 212 of FIG. 278 (SEQ ID NO:387).

In another aspect, the invention concerns an isolated PRO1312 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 15 to about 212, inclusive of FIG. 278 (SEQ ID NO:387).

In a further aspect, the invention concerns an isolated PRO1312 polypeptide, comprising an amino acid sequence scoring at least about 80% positives, preferably at least about 85% positives, more preferably at least about 90% positives, most preferably at least about 95% positives when compared with the amino acid sequence of residues 15 to 212 of FIG. 278 (SEQ ID NO:387).

In yet another aspect, the invention concerns an isolated PRO1312 polypeptide, comprising the sequence of amino acid residues 15 to about 212, inclusive of FIG. 278 (SEQ ID NO:387), or a fragment thereof sufficient to provide a binding site for an anti-PRO1312 antibody. Preferably, the PRO1312 fragment retains a qualitative biological activity of a native PRO1312 polypeptide.

In a still further aspect, the invention provides a polypeptide produced by (i) hybridizing a test DNA molecule under stringent conditions with (a) a DNA molecule encoding a PRO1312 polypeptide having the sequence of amino acid residues from about 15 to about 212, inclusive of FIG. 278 (SEQ ID NO:387), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

122. PRO1192

A cDNA clone (DNA62814-1521) has been identified that encodes a novel polypeptide having homology to myelin P0 protein and designated in the present application as "PRO1192."

In one embodiment, the invention provides an isolated nucleic acid molecule comprising DNA encoding a PRO1192 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1192 polypeptide having the sequence of amino acid residues from about 22 to about 215, inclusive of FIG. 280 (SEQ ID NO:389), or (b) the complement of the DNA molecule of (a).

In another aspect, the invention concerns an isolated nucleic acid molecule encoding a PRO1192 polypeptide comprising DNA hybridizing to the complement of the nucleic acid between about residues 184 and about 764, inclusive, of FIG. 279 (SEQ ID NO:388). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203093 (DNA62814-1521), or (b) the complement of the DNA molecule of (a). In a preferred embodiment, the nucleic acid comprises a DNA encoding the same mature polypeptide encoded by the human protein cDNA in ATCC Deposit No. 203093 (DNA62814-1521).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 215, inclusive of FIG. 280 (SEQ ID NO:389), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1192 polypeptide having the sequence of amino acid residues from about 22 to about 215, inclusive of FIG. 280 (SEQ ID NO:389), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1192 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 21 in the sequence of FIG. 280 (SEQ ID NO:389). The transmembrane domain has been tentatively identified as extending from about amino acid position 153 through about amino acid position 176 in the PRO1192 amino acid sequence (FIG. 280, SEQ ID NO:389).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 215, inclusive of FIG. 280 (SEQ ID NO:389), or (b) the complement of the DNA of (a).

Another embodiment is directed to fragments of a PRO1192 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1192 polypeptide encoded by any of the isolated nucleic acid sequences hereinabove defined.

In a specific aspect, the invention provides isolated native sequence PRO1192 polypeptide, which in one embodiment, includes an amino acid sequence comprising residues 22 to 215 of FIG. 280 (SEQ ID NO:389).

In another aspect, the invention concerns an isolated PRO1192 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 215, inclusive of FIG. 280 (SEQ ID NO:389).

In a further aspect, the invention concerns an isolated PRO1192 polypeptide, comprising an amino acid sequence scoring at least about 80% positives, preferably at least about 85% positives, more preferably at least about 90% positives, most preferably at least about 95% positives when compared with the amino acid sequence of residues 22 to 215 of FIG. 280 (SEQ ID NO:389).

In yet another aspect, the invention concerns an isolated PRO1192 polypeptide, comprising the sequence of amino acid residues 22 to about 215, inclusive of FIG. 280 (SEQ ID NO:389), or a fragment thereof sufficient to provide a binding site for an anti-PRO1192 antibody. Preferably, the PRO1192 fragment retains a qualitative biological activity of a native PRO1192 polypeptide.

In a still further aspect, the invention provides a polypeptide produced by (i) hybridizing a test DNA molecule under stringent conditions with (a) a DNA molecule encoding a PRO1192 polypeptide having the sequence of amino acid residues from about 22 to about 215, inclusive of FIG. 280 (SEQ ID NO:389), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1192 polypeptide. In a particular embodiment, the agonist or antagonist is an anti-PRO1192 antibody.

In a further embodiment, the invention concerns a method of identifying agonists or antagonists of a native PRO1192 polypeptide, by contacting the native PRO1192 polypeptide with a candidate molecule and monitoring a biological activity mediated by said polypeptide.

In a still further embodiment, the invention concerns a composition comprising a PRO1192 polypeptide, or an agonist or antagonist as hereinabove defined, in combination with a pharmaceutically acceptable carrier.

123. PRO1160

A cDNA clone (DNA62872-1509) has been identified that encodes a novel secreted polypeptide, designated in the present application as "PRO1160".

In one embodiment, the invention provides an isolated nucleic acid molecule comprising DNA encoding a PRO1160 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1160 polypeptide having the sequence of amino acid residues from about 1 or about 20 to about 90, inclusive of FIG. 282 (SEQ ID NO:394), or (b) the complement of the DNA molecule of (a).

In another aspect, the invention concerns an isolated nucleic acid molecule encoding a PRO1160 polypeptide comprising DNA hybridizing to the complement of the nucleic acid between about nucleotides 40 or about 97 and about 309, inclusive, of FIG. 282 (SEQ ID NO:394). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203100 (DNA62872-1509) or (b) the complement of the nucleic acid molecule of (a). In a preferred embodiment, the nucleic acid comprises a DNA encoding the same mature polypeptide encoded by the human protein cDNA in ATCC Deposit No. 203100 (DNA62872-1509).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 90, inclusive of FIG. 282 (SEQ ID NO:394), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1160 polypeptide having the sequence of amino acid residues from 1 or about 20 to about 90, inclusive of FIG. 282 (SEQ ID NO:394), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1160 polypeptide, with or without the N-terminal signal sequence and/or the initiating methionine, or is complementary to such encoding nucleic acid molecule. The signal peptide has been tentatively identified as extending from about amino acid position 1 to about amino acid position 19 in the sequence of FIG. 282 (SEQ ID NO:394).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 90, inclusive of FIG. 282 (SEQ ID NO:394), or (b) the complement of the DNA of (a).

Another embodiment is directed to fragments of a PRO1160 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 281 (SEQ ID NO:393).

In another embodiment, the invention provides isolated PRO1160 polypeptide encoded by any of the isolated nucleic acid sequences hereinabove identified.

In a specific aspect, the invention provides isolated native sequence PRO1160 polypeptide, which in certain embodiments, includes an amino acid sequence comprising residues 1 or about 20 to about 90 of FIG. 282 (SEQ ID NO:394).

In another aspect, the invention concerns an isolated PRO1160 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 90, inclusive of FIG. 282 (SEQ ID NO:394).

In a further aspect, the invention concerns an isolated PRO1160 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 90, inclusive of FIG. 282 (SEQ ID NO:394).

In yet another aspect, the invention concerns an isolated PRO1160 polypeptide, comprising the sequence of amino acid residues 1 or about 20 to about 90, inclusive of FIG. 282 (SEQ ID NO:394), or a fragment thereof sufficient to provide a binding site for an anti-PRO1160 antibody. Preferably, the PRO1160 fragment retains a qualitative biological activity of a native PRO1160 polypeptide.

In a still further aspect, the invention provides a polypeptide produced by (i) hybridizing a test DNA molecule under stringent conditions with (a) a DNA molecule encoding a PRO1160 polypeptide having the sequence of amino acid residues from about 1 or about 20 to about 90, inclusive of FIG. 282 (SEQ ID NO:394), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

124. PRO1187

A cDNA clone (DNA62876-1517) has been identified that encodes a novel polypeptide having sequence identity with endo-beta-1,4-xylanase and designated in the present application as "PRO1187."

In one embodiment, the invention provides an isolated nucleic acid molecule comprising DNA encoding a PRO1187 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1187 polypeptide having the sequence of amino acid residues from about 18 to about 120, inclusive of FIG. 284 (SEQ ID NO:399), or (b) the complement of the DNA molecule of (a).

In another aspect, the invention concerns an isolated nucleic acid molecule encoding a PRO1187 polypeptide comprising DNA hybridizing to the complement of the nucleic acid between about residues 172 and about 480, inclusive, of FIG. 283 (SEQ ID NO:398). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203095 (DNA62876-1517), or (b) the complement of the DNA molecule of (a). In a preferred embodiment, the nucleic acid comprises a DNA encoding the same mature polypeptide encoded by the human protein cDNA in ATCC Deposit No. 203095 (DNA62876-1517).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 120, inclusive of FIG. 284 (SEQ ID NO:399), or the complement of the DNA of (a).

In a further aspect, the invention concerns an isolated nucleic acid molecule having at least about 50 nucleotides, and preferably at least about 100 nucleotides nucleotides and produced by hybridizing a test DNA molecule under stringent conditions with (a) a DNA molecule encoding a PRO1187 polypeptide having the sequence of amino acid residues from about 18 to about 120, inclusive of FIG. 284 (SEQ ID NO:399), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 120, inclusive of FIG. 284 (SEQ ID NO:399), or (b) the complement of the DNA of (a).

Another embodiment is directed to fragments of a PRO1187 polypeptide coding sequence that may find use as hybridization probes. Such nucleic acid fragments are from about 20 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO1187 polypeptide encoded by any of the isolated nucleic acid sequences hereinabove defined.

In a specific aspect, the invention provides isolated native sequence PRO1187 polypeptide, which in one embodiment, includes an amino acid sequence comprising residues 18 through 120 of FIG. 284 (SEQ ID NO:399).

In another aspect, the invention concerns an isolated PRO1187 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 120, inclusive of FIG. 284 (SEQ ID NO:399).

In a further aspect, the invention concerns an isolated PRO1187 polypeptide, comprising an amino acid sequence scoring at least about 80% positives, preferably at least about 85% positives, more preferably at least about 90% positives, most preferably at least about 95% positives when compared with the amino acid sequence of residues 18 through 120 of FIG. 284 (SEQ ID NO:399).

In yet another aspect, the invention concerns an isolated PRO1187 polypeptide, comprising the sequence of amino acid residues 18 to about 120, inclusive of FIG. 284 (SEQ ID NO:399), or a fragment thereof sufficient to provide a binding site for an anti-PRO1187 antibody. Preferably, the PRO1187 fragment retains a qualitative biological activity of a native PRO1187 polypeptide.

In a still further aspect, the invention provides a polypeptide produced by (i) hybridizing a test DNA molecule under stringent conditions with (a) a DNA molecule encoding a PRO1187 polypeptide having the sequence of amino acid residues from about 18 to about 120, inclusive of FIG. 284 (SEQ ID NO:399), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1187 polypeptide. In a particular embodiment, the agonist or antagonist is an anti-PRO1187 antibody.

In a further embodiment, the invention concerns a method of identifying agonists or antagonists of a native PRO1187 polypeptide, by contacting the native PRO1187 polypeptide with a candidate molecule and monitoring a biological activity mediated by said polypeptide.

In a still further embodiment, the invention concerns a composition comprising a PRO1187 polypeptide, or an agonist or antagonist as hereinabove defined, in combination with a pharmaceutically acceptable carrier.

125. PRO1185

A cDNA clone (DNA62881-1515) has been identified that encodes a novel polypeptide having sequence identity to a glucose repression regulatory protein, tup1, and designated in the present application as "PRO1185."

In one embodiment, the invention provides an isolated nucleic acid molecule comprising DNA encoding a PRO1185 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1185 polypeptide having the sequence of amino acid residues from about 22 to about 198, inclusive of FIG. 286 (SEQ ID NO:401), or (b) the complement of the DNA molecule of (a).

In another aspect, the invention concerns an isolated nucleic acid molecule encoding a PRO1185 polypeptide comprising DNA hybridizing to the complement of the nucleic acid between about residues 67 and about 597, inclusive, of FIG. 285 (SEQ ID NO:400). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203096 (DNA62881-1515), or (b) the complement of the DNA molecule of (a). In a preferred embodiment, the nucleic acid comprises a DNA encoding the same mature polypeptide encoded by the human protein cDNA in ATCC Deposit No. 203096 (DNA62881-1515).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 198, inclusive of FIG. 286 (SEQ ID NO:401), or the complement of the DNA of (a).

In a further aspect, the invention concerns an isolated nucleic acid molecule having at least about 50 nucleotides, and preferably at least about 100 nucleotides nucleotides and produced by hybridizing a test DNA molecule under stringent conditions with (a) a DNA molecule encoding a PRO1185 polypeptide having the sequence of amino acid residues from about 22 to about 198, inclusive of FIG. 286 (SEQ ID NO:401), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 198, inclusive of FIG. 286 (SEQ ID NO:401), or (b) the complement of the DNA of (a).

Another embodiment is directed to fragments of a PRO1185 polypeptide coding sequence that may find use as hybridization probes. Such nucleic acid fragments are from about 20 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO1185 polypeptide encoded by any of the isolated nucleic acid sequences hereinabove defined.

In a specific aspect, the invention provides isolated native sequence PRO1185 polypeptide, which in one embodiment, includes an amino acid sequence comprising residues 22 through 198 of FIG. 286 (SEQ ID NO:401).

In another aspect, the invention concerns an isolated PRO1185 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 198, inclusive of FIG. 286 (SEQ ID NO:401).

In a further aspect, the invention concerns an isolated PRO1185 polypeptide, comprising an amino acid sequence scoring at least about 80% positives, preferably at least about 85% positives, more preferably at least about 90% positives, most preferably at least about 95% positives when compared with the amino acid sequence of residues 22 through 198 of FIG. 286 (SEQ ID NO:401).

In yet another aspect, the invention concerns an isolated PRO1185 polypeptide, comprising the sequence of amino acid residues 22 to about 198, inclusive of FIG. 286 (SEQ ID NO:401), or a fragment thereof sufficient to provide a binding site for an anti-PRO1185 antibody. Preferably, the PRO1185 fragment retains a qualitative biological activity of a native PRO1185 polypeptide.

In a still further aspect, the invention provides a polypeptide produced by (i) hybridizing a test DNA molecule under stringent conditions with (a) a DNA molecule encoding a PRO1185 polypeptide having the sequence of amino acid residues from about 22 to about 198, inclusive of FIG. 286 (SEQ ID NO:401), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1185 polypeptide. In a particular embodiment, the agonist or antagonist is an anti-PRO1185 antibody.

In a further embodiment, the invention concerns a method of identifying agonists or antagonists of a native PRO1185 polypeptide, by contacting the native PRO1185 polypeptide with a candidate molecule and monitoring a biological activity mediated by said polypeptide.

In a still further embodiment, the invention concerns a composition comprising a PRO1185 polypeptide, or an agonist or antagonist as hereinabove defined, in combination with a pharmaceutically acceptable carrier.

126. PRO1345

A cDNA clone (DNA64852-1589) has been identified, having homology to nucleic acid encoding tetranectin protein that encodes a novel polypeptide, designated in the present application as "PRO1345".

In one embodiment, the invention provides an isolated nucleic acid molecule comprising DNA encoding a PRO1345 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1345 polypeptide having the sequence of amino acid residues from about 1 or about 32 to about 206, inclusive of FIG. 288 (SEQ ID NO:403), or (b) the complement of the DNA molecule of (a).

In another aspect, the invention concerns an isolated nucleic acid molecule encoding a PRO1345 polypeptide comprising DNA hybridizing to the complement of the nucleic acid between about nucleotides 7 or about 100 and about 624, inclusive, of FIG. 287 (SEQ ID NO:402). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203127 (DNA64852-1589) or (b) the complement of the nucleic acid molecule of (a). In a preferred embodiment, the nucleic acid comprises a DNA encoding the same mature polypeptide encoded by the human protein cDNA in ATCC Deposit No. 203127 (DNA64852-1589).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 32 to about 206, inclusive of FIG. 288 (SEQ ID NO:403), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1345 polypeptide having the sequence of amino acid residues from 1 or about 32 to about 206, inclusive of FIG. 288 (SEQ ID NO:403), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1345 polypeptide, with or without the N-terminal signal sequence and/or the initiating methionine, or is complementary to such encoding nucleic acid molecule. The signal peptide has been tentatively identified as extending from about amino acid position 1 or amino acid 10 to about amino acid position 31 in the sequence of FIG. 288 (SEQ ID NO:403).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 32 to about 206, inclusive of FIG. 288 (SEQ ID NO:403), or (b) the complement of the DNA of (a).

Another embodiment is directed to fragments of a PRO1345 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 287 (SEQ ID NO:402).

In another embodiment, the invention provides isolated PRO1345 polypeptide encoded by any of the isolated nucleic acid sequences hereinabove identified.

In a specific aspect, the invention provides isolated native sequence PRO1345 polypeptide, which in certain embodiments, includes an amino acid sequence comprising residues 1 or about 32 to about 206 of FIG. 288 (SEQ ID NO:403).

In another aspect, the invention concerns an isolated PRO1345 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 32 to about 206, inclusive of FIG. 288 (SEQ ID NO:403).

In a further aspect, the invention concerns an isolated PRO1345 polypeptide, comprising an amino acid sequence scoring at least about 80% positives, preferably at least about 85% positives, more preferably at least about 90% positives, most preferably at least about 95% positives when compared with the amino acid sequence of residues 1 or about 32 to about 206, inclusive of FIG. 288 (SEQ ID NO:403).

In yet another aspect, the invention concerns an isolated PRO1345 polypeptide, comprising the sequence of amino acid residues 1 or about 32 to about 206, inclusive of FIG. 288 (SEQ ID NO:403), or a fragment thereof sufficient to provide a binding site for an anti-PRO1345 antibody. Preferably, the PRO1345 fragment retains a qualitative biological activity of a native PRO1345 polypeptide.

In a still further aspect, the invention provides a polypeptide produced by (i) hybridizing a test DNA molecule under stringent conditions with (a) a DNA molecule encoding a PRO1345 polypeptide having the sequence of amino acid residues from about 1 or about 32 to about 206, inclusive of FIG. 288 (SEQ ID NO:403), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1345 polypeptide. In a particular embodiment, the agonist or antagonist is an anti-PRO1345 antibody.

In a further embodiment, the invention concerns a method of identifying agonists or antagonists of a native PRO1345 polypeptide by contacting the native PRO1345 polypeptide with a candidate molecule and monitoring a biological activity mediated by said polypeptide.

In a still further embodiment, the invention concerns a composition comprising a PRO1345 polypeptide, or an agonist or antagonist as hereinabove defined, in combination with a pharmaceutically acceptable carrier.

127. PRO1245

A cDNA clone (DNA64884-1527) has been identified that encodes a novel secreted polypeptide designated in the present application as "PRO1245."

In one embodiment, the invention provides an isolated nucleic acid molecule comprising DNA encoding a PRO1245 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1245 polypeptide having the sequence of amino acid residues from about 19 to about 104, inclusive of FIG. 290 (SEQ ID NO:408), or (b) the complement of the DNA molecule of (a).

In another aspect, the invention concerns an isolated nucleic acid molecule encoding a PRO1245 polypeptide comprising DNA hybridizing to the complement of the nucleic acid between about residues 133 and about 390, inclusive, of FIG. 289 (SEQ ID NO:407). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203155 (DNA64884-1245), or (b) the complement of the DNA molecule of (a). In a preferred embodiment, the nucleic acid comprises a DNA encoding the same mature polypeptide encoded by the human protein cDNA in ATCC Deposit No. 203155 (DNA64884-1245).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 104, inclusive of FIG. 290 (SEQ ID NO:408), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1245 polypeptide having the sequence of amino acid residues from about 19 to about 104, inclusive of FIG. 290 (SEQ ID NO:408), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1245 polypeptide, with or without the N-terminal signal sequence and/or the initiating methionine, or is complementary to such encoding nucleic acid molecule. The signal peptide has been tentatively identified as extending from amino acid position 1 through about amino acid position 18 in the sequence of FIG. 290 (SEQ ID NO:408).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 104, inclusive of FIG. 290 (SEQ ID NO:408), or (b) the complement of the DNA of (a).

Another embodiment is directed to fragments of a PRO1245 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1245 polypeptide encoded by any of the isolated nucleic acid sequences hereinabove defined.

In a specific aspect, the invention provides isolated native sequence PRO1245 polypeptide, which in one embodiment, includes an amino acid sequence comprising residues 19 to 104 of FIG. 290 (SEQ ID NO:408).

In another aspect, the invention concerns an isolated PRO1245 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 104, inclusive of FIG. 290 (SEQ ID NO:408).

In a further aspect, the invention concerns an isolated PRO1245 polypeptide, comprising an amino acid sequence scoring at least about 80% positives, preferably at least about 85% positives, more preferably at least about 90% positives, most preferably at least about 95% positives when compared with the amino acid sequence of residues 19 to 104 of FIG. 290 (SEQ ID NO:408).

In yet another aspect, the invention concerns an isolated PRO1245 polypeptide, comprising the sequence of amino acid residues 19 to about 104, inclusive of FIG. 290 (SEQ ID NO:408), or a fragment thereof sufficient to provide a binding site for an anti-PRO1245 antibody. Preferably, the PRO1245 fragment retains a qualitative biological activity of a native PRO1245 polypeptide.

In a still further aspect, the invention provides a polypeptide produced by (i) hybridizing a test DNA molecule under stringent conditions with (a) a DNA molecule encoding a PRO1245 polypeptide having the sequence of amino acid residues from about 19 to about 104, inclusive of FIG. 290 (SEQ ID NO:408), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

128. PRO1358

A cDNA clone (DNA64890-1612) has been identified that encodes a novel polypeptide having sequence identity with RASP-1 and designated in the present application as "PRO1358."

In one embodiment, the invention provides an isolated nucleic acid molecule comprising DNA encoding a PRO1358 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1358 polypeptide having the sequence of amino acid residues from about 19 to about 444, inclusive of FIG. 292 (SEQ ID NO:410), or (b) the complement of the DNA molecule of (a).

In another aspect, the invention concerns an isolated nucleic acid molecule encoding a PRO1358 polypeptide comprising DNA hybridizing to the complement of the nucleic acid between about residues 140 and about 1417, inclusive, of FIG. 292 (SEQ ID NO:410). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203131 (DNA64890-1612), or (b) the complement of the DNA molecule of (a). In a preferred embodiment, the nucleic acid comprises a DNA encoding the same mature polypeptide encoded by the human protein cDNA in ATCC Deposit No. 203131 (DNA64890-1612).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 444, inclusive of FIG. 292 (SEQ ID NO:410), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1358 polypeptide having the sequence of amino acid residues from about 19 to about 444, inclusive of FIG. 292 (SEQ ID NO:410), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 444, inclusive of FIG. 292 (SEQ ID NO:410), or (b) the complement of the DNA of (a).

Another embodiment is directed to fragments of a PRO1358 polypeptide coding sequence that may find use as hybridization probes. Such nucleic acid fragments are from about 80 nucleotides to about 120 nucleotides in length.

In another embodiment, the invention provides isolated PRO1358 polypeptide encoded by any of the isolated nucleic acid sequences hereinabove defined.

In a specific aspect, the invention provides isolated native sequence PRO1358 polypeptide, which in one embodiment, includes an amino acid sequence comprising residues 19 through 444 of FIG. 292 (SEQ ID NO:410).

In another aspect, the invention concerns an isolated PRO1358 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 444, inclusive of FIG. 292 (SEQ ID NO:410).

In a further aspect, the invention concerns an isolated PRO1358 polypeptide, comprising an amino acid sequence scoring at least about 80% positives, preferably at least about 85% positives, more preferably at least about 90% positives, most preferably at least about 95% positives when compared with the amino acid sequence of residues 19 through 444 of FIG. 292 (SEQ ID NO:410).

In yet another aspect, the invention concerns an isolated PRO1358 polypeptide, comprising the sequence of amino acid residues 19 to about 444, inclusive of FIG. 292 (SEQ ID NO:410), or a fragment thereof sufficient to provide a binding site for an anti-PRO1358 antibody specific therefore. Preferably, the PRO1358 fragment retains a qualitative biological activity of a native PRO1358 polypeptide.

In a still further aspect, the invention provides a polypeptide produced by (i) hybridizing a test DNA molecule under stringent conditions with (a) a DNA molecule encoding a PRO1358 polypeptide having the sequence of amino acid residues from about 19 to about 444, inclusive of FIG. 292 (SEQ ID NO:410), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1358 polypeptide. In a particular embodiment, the agonist or antagonist is an anti-PRO1358 antibody.

In a further embodiment, the invention concerns a method of identifying agonists or antagonists of a native PRO1358 polypeptide, by contacting the native PRO1358 polypeptide with a candidate molecule and monitoring a biological activity mediated by said polypeptide.

In a still further embodiment, the invention concerns a composition comprising a PRO1358 polypeptide, or an agonist or antagonist as hereinabove defined, in combination with a pharmaceutically acceptable carrier.

129. PRO1195

A cDNA clone (DNA65412-1523) has been identified that encodes a novel polypeptide having sequence identity with a mouse proline rich acidic protein and designated in the present application as "PRO1195."

In one embodiment, the invention provides an isolated nucleic acid molecule comprising DNA encoding a PRO1195 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1195 polypeptide having the sequence of amino acid residues from about 23 to about 151, inclusive of FIG. 294 (SEQ ID NO:412), or (b) the complement of the DNA molecule of (a).

In another aspect, the invention concerns an isolated nucleic acid molecule encoding a PRO1195 polypeptide comprising DNA hybridizing to the complement of the nucleic acid between about residues 124 and about 510, inclusive, of FIG. 293 (SEQ ID NO:411). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203094 (DNA65412-1523), or (b) the complement of the DNA molecule of (a). In a preferred embodiment, the nucleic acid comprises a DNA encoding the same mature polypeptide encoded by the human protein cDNA in ATCC Deposit No. 203094 (DNA65412-1523).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 23 to about 151, inclusive of FIG. 294 (SEQ ID NO:412), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1195 polypeptide having the sequence of amino acid residues from about 23 to about 151, inclusive of FIG. 294 (SEQ ID NO:412), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 23 to about 151, inclusive of FIG. 294 (SEQ ID NO:412), or (b) the complement of the DNA of (a).

Another embodiment is directed to fragments of a PRO1195 polypeptide coding sequence that may find use as hybridization probes. Such nucleic acid fragments are from about 20 through about 80 nucleotides in length, preferably from about 20 through about 60 nucleotides in length, more preferably from about 20 through about 50 nucleotides in length, and most preferably from about 20 through about 40 nucleotides in length.

In another embodiment, the invention provides isolated PRO1195 polypeptide encoded by any of the isolated nucleic acid sequences hereinabove defined.

In a specific aspect, the invention provides isolated native sequence PRO1195 polypeptide, which in one embodiment, includes an amino acid sequence comprising residues 23 through 151 of FIG. 294 (SEQ ID NO:412).

In another aspect, the invention concerns an isolated PRO1195 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 23 to about 151, inclusive of FIG. 294 (SEQ ID NO:412).

In a further aspect, the invention concerns an isolated PRO1195 polypeptide, comprising an amino acid sequence scoring at least about 80% positives, preferably at least about 85% positives, more preferably at least about 90% positives, most preferably at least about 95% positives when compared with the amino acid sequence of residues 23 through 151 of FIG. 294 (SEQ ID NO:412).

In a still further aspect, the invention provides a polypeptide produced by (i) hybridizing a test DNA molecule under stringent conditions with (a) a DNA molecule encoding a PRO1195 polypeptide having the sequence of amino acid residues from about 23 to about 151, inclusive of FIG. 294 (SEQ ID NO:412), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1195 polypeptide. In a particular embodiment, the agonist or antagonist is an anti-PRO1195 antibody.

In a further embodiment, the invention concerns a method of identifying agonists or antagonists of a native PRO1195 polypeptide, by contacting the native PRO1195 polypeptide with a candidate molecule and monitoring a biological activity mediated by said polypeptide.

In a still further embodiment, the invention concerns a composition comprising a PRO1195 polypeptide, or an agonist or antagonist as hereinabove defined, in combination with a pharmaceutically acceptable carrier.

130. PRO1270

A cDNA clone (DNA66308-1537) has been identified, having homology to nucleic acid encoding a lectin protein, that encodes a novel polypeptide, designated in the present application as "PRO1270".

In one embodiment, the invention provides an isolated nucleic acid molecule comprising DNA encoding a PRO1270 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1270 polypeptide having the sequence of amino acid residues from about 1 or about 17 to about 313, inclusive of FIG. 296 (SEQ ID NO:414), or (b) the complement of the DNA molecule of (a).

In another aspect, the invention concerns an isolated nucleic acid molecule encoding a PRO1270 polypeptide comprising DNA hybridizing to the complement of the nucleic acid between about nucleotides 103 or about 151 and about 1041, inclusive, of FIG. 295 (SEQ ID NO:413). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203159 (DNA66308-1537) or (b) the complement of the nucleic acid molecule of (a). In a preferred embodiment, the nucleic acid comprises a DNA encoding the same mature polypeptide encoded by the human protein cDNA in ATCC Deposit No. 203159 (DNA66308-1537).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 17 to about 313, inclusive of FIG. 296 (SEQ ID NO:414), or (b) the complement of the DNA of (a).

In a further aspect, the invention concerns an isolated nucleic acid molecule having at least 285 nucleotides and produced by hybridizing a test DNA molecule under stringent conditions with (a) a DNA molecule encoding a PRO1270 polypeptide having the sequence of amino acid residues from 1 or about 17 to about 313, inclusive of FIG. 296 (SEQ ID NO:414), or (b) the complement of the DNA molecule of(a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1270 polypeptide, with or without the N-terminal signal sequence and/or the initiating methionine, or is complementary to such encoding nucleic acid molecule. The signal peptide has been tentatively identified as extending from about amino acid position 1 to about amino acid position 16 in the sequence of FIG. 296 (SEQ ID NO:414).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 17 to about 313, inclusive of FIG. 296 (SEQ ID NO:414), or (b) the complement of the DNA of (a).

Another embodiment is directed to fragments of a PRO1270 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 295 (SEQ ID NO:413).

In another embodiment, the invention provides isolated PRO1270 polypeptide encoded by any of the isolated nucleic acid sequences hereinabove identified.

In a specific aspect, the invention provides isolated native sequence PRO1270 polypeptide, which in certain embodiments, includes an amino acid sequence comprising residues 1 or about 17 to about 313 of FIG. 296 (SEQ ID NO:414).

In another aspect, the invention concerns an isolated PRO1270 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 17 to about 313, inclusive of FIG. 296 (SEQ ID NO:414).

In a further aspect, the invention concerns an isolated PRO1270 polypeptide, comprising an amino acid sequence scoring at least about 80% positives, preferably at least about 85% positives, more preferably at least about 90% positives, most preferably at least about 95% positives when compared with the amino acid sequence of residues 1 or about 17 to about 313, inclusive of FIG. 296 (SEQ ID NO:414).

In yet another aspect, the invention concerns an isolated PRO1270 polypeptide, comprising the sequence of amino acid residues 1 or about 17 to about 313, inclusive of FIG. 296 (SEQ ID NO:414), or a fragment thereof sufficient to provide a binding site for an anti-PRO1270 antibody. Preferably, the PRO1270 fragment retains a qualitative biological activity of a native PRO1270 polypeptide.

In a still further aspect, the invention provides a polypeptide produced by (i) hybridizing a test DNA molecule under stringent conditions with (a) a DNA molecule encoding a PRO1270 polypeptide having the sequence of amino acid residues from about 1 or about 17 to about 313, inclusive of FIG. 296 (SEQ ID NO:414), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1270 polypeptide. In a particular embodiment, the agonist or antagonist is an anti-PRO1270 antibody.

In a further embodiment, the invention concerns a method of identifying agonists or antagonists of a native PRO1270 polypeptide by contacting the native PRO1270 polypeptide with a candidate molecule and monitoring a biological activity mediated by said polypeptide.

In a still further embodiment, the invention concerns a composition comprising a PRO1270 polypeptide, or an agonist or antagonist as hereinabove defined, in combination with a pharmaceutically acceptable carrier.

131. PRO1271

A cDNA clone (DNA66309-1538) has been identified that encodes a novel polypeptide having serine and threonine rich regions designated in the present application as "PRO1271" polypeptides.

In one embodiment, the invention provides an isolated nucleic acid molecule comprising DNA encoding a PRO1271 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1271 polypeptide having the sequence of amino acid residues from about 32 to about 208, inclusive of FIG. 298 (SEQ ID NO:416), or (b) the complement of the DNA molecule of (a).

In another aspect, the invention concerns an isolated nucleic acid molecule encoding a PRO1271 polypeptide comprising DNA hybridizing to the complement of the nucleic acid between about residues 187 and about 717, inclusive, of FIG. 297 (SEQ ID NO:415). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203235 (DNA66309-1538), or (b) the complement of the DNA molecule of (a). In a preferred embodiment, the nucleic acid comprises a DNA encoding the same mature polypeptide encoded by the human protein cDNA in ATCC Deposit No. 203235 (DNA66309-1538).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 32 to about 208, inclusive of FIG. 298 (SEQ ID NO:416), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1271 polypeptide having the sequence of amino acid residues from about 32 to about 208, inclusive of FIG. 298 (SEQ ID NO:416), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1271 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 31 in the sequence of FIG. 298 (SEQ ID NO:416). The transmembrane domain has been tentatively identified as extending from about amino acid position 166 through about amino acid position 187 in the PRO1271 amino acid sequence (FIG. 298, SEQ ID NO:416).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 32 to about 208, inclusive of FIG. 298 (SEQ ID NO:416), or (b) the complement of the DNA of (a).

Another embodiment is directed to fragments of a PRO1271 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1271 polypeptide encoded by any of the isolated nucleic acid sequences hereinabove defined.

In a specific aspect, the invention provides isolated native sequence PRO1271 polypeptide, which in one embodiment, includes an amino acid sequence comprising residues 32 through 208 of FIG. 298 (SEQ ID NO:416).

In another aspect, the invention concerns an isolated PRO1271 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 32 to about 208, inclusive of FIG. 298 (SEQ ID NO:416).

In a further aspect, the invention concerns an isolated PRO1271 polypeptide, comprising an amino acid sequence scoring at least about 80% positives, preferably at least about 85% positives, more preferably at least about 90% positives, most preferably at least about 95% positives when compared with the amino acid sequence of residues 32 through 208 of FIG. 298 (SEQ ID NO:416).

In yet another aspect, the invention concerns an isolated PRO1271 polypeptide, comprising the sequence of amino acid residues 32 to about 208, inclusive of FIG. 298 (SEQ ID NO:416), or a fragment thereof sufficient to provide a binding site for an anti-PRO1271 antibody. Preferably, the PRO1271 fragment retains a qualitative biological activity of a native PRO1271 polypeptide.

In a still further aspect, the invention provides a polypeptide produced by (i) hybridizing a test DNA molecule under stringent conditions with (a) a DNA molecule encoding a PRO1271 polypeptide having the sequence of amino acid residues from about 32 to about 208, inclusive of FIG. 298 (SEQ ID NO:416), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1271 polypeptide. In a particular embodiment, the agonist or antagonist is an anti-PRO1271 antibody.

In a further embodiment, the invention concerns a method of identifying agonists or antagonists of a native PRO1271 polypeptide, by contacting the native PRO1271 polypeptide with a candidate molecule and monitoring a biological activity mediated by said polypeptide.

In a still further embodiment, the invention concerns a composition comprising a PRO1271 polypeptide, or an agonist or antagonist as hereinabove defined, in combination with a pharmaceutically acceptable carrier.

132. PRO1375

A cDNA clone (DNA67004-1614) has been identified that encodes a novel polypeptide having sequence identity with PUT2 and designated in the present application as "PRO1375."

In one embodiment, the invention provides an isolated nucleic acid molecule comprising DNA encoding a PRO1375 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1375 polypeptide having the sequence of amino acid residues from about 1 to about 198, inclusive of FIG. 300 (SEQ ID NO:418), or (b) the complement of the DNA molecule of (a).

In another aspect, the invention concerns an isolated nucleic acid molecule encoding a PRO1375 polypeptide comprising DNA hybridizing to the complement of the nucleic acid between about residues 104 and about 697, inclusive, of FIG. 299 (SEQ ID NO:417). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203115 (DNA67004-1614), or (b) the complement of the DNA molecule of (a). In a preferred embodiment, the nucleic acid comprises a DNA encoding the same mature polypeptide encoded by the human protein cDNA in ATCC Deposit No. 203115 (DNA67004-1614).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 198, inclusive of FIG. 300 (SEQ ID NO:418), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1375 polypeptide having the sequence of amino acid residues from about 1 to about 198, inclusive of FIG. 300 (SEQ ID NO:418), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1375 polypeptide in its soluble form, i.e. transmembrane domains deleted or inactivated variants, or is complementary to such encoding nucleic acid molecule. The transmembrane domains have been tentatively identified as at about amino acid positions 11–28 (type II) and 103–125 of SEQ ID NO:418.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 198, inclusive of FIG. 300 (SEQ ID NO:418), or (b) the complement of the DNA of (a).

Another embodiment is directed to fragments of a PRO1375 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1375 polypeptide encoded by any of the isolated nucleic acid sequences hereinabove defined.

In a specific aspect, the invention provides isolated native sequence PRO1375 polypeptide, which in one embodiment, includes an amino acid sequence comprising residues 1 through 198 of FIG. 300 (SEQ ID NO:418).

In another aspect, the invention concerns an isolated PRO1375 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 198, inclusive of FIG. 300 (SEQ ID NO:418).

In a further aspect, the invention concerns an isolated PRO1375 polypeptide, comprising an amino acid sequence scoring at least about 80% positives, preferably at least about 85% positives, more preferably at least about 90% positives, most preferably at least about 95% positives when compared with the amino acid sequence of residues 1 through 198 of FIG. 300 (SEQ ID NO:418).

In yet another aspect, the invention concerns an isolated PRO1375 polypeptide, comprising the sequence of amino acid residues 1 to about 198, inclusive of FIG. 300 (SEQ ID NO:418), or a fragment thereof sufficient to provide a binding site for an anti-PRO1375 antibody. Preferably, the PRO1375 fragment retains a qualitative biological activity of a native PRO1375 polypeptide.

In a still further aspect, the invention provides a polypeptide produced by (i) hybridizing a test DNA molecule under stringent conditions with (a) a DNA molecule encoding a PRO1375 polypeptide having the sequence of amino acid residues from about 1 to about 198, inclusive of FIG. 300 (SEQ ID NO:418), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1375 polypeptide. In a particular embodiment, the agonist or antagonist is an anti-PRO1375 antibody.

In a further embodiment, the invention concerns a method of identifying agonists or antagonists of a native PRO1375 polypeptide, by contacting the native PRO1375 polypeptide with a candidate molecule and monitoring a biological activity mediated by said polypeptide.

In a still further embodiment, the invention concerns a composition comprising a PRO1375 polypeptide, or an agonist or antagonist as hereinabove defined, in combination with a pharmaceutically acceptable carrier.

133. PRO1385

A cDNA clone (DNA68869-1610) has been identified that encodes a novel secreted polypeptide, designated in the present application as "PRO1385".

In one embodiment, the invention provides an isolated nucleic acid molecule comprising DNA encoding a PRO1385 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1385 polypeptide having the sequence of amino acid residues from about 1 or about 29 to about 128, inclusive of FIG. 302 (SEQ ID NO:420), or (b) the complement of the DNA molecule of (a).

In another aspect, the invention concerns an isolated nucleic acid molecule encoding a PRO1385 polypeptide comprising DNA hybridizing to the complement of the nucleic acid between about nucleotides 26 or about 110 and about 409, inclusive, of FIG. 301 (SEQ ID NO:419). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203164 (DNA68869-1610) or (b) the complement of the nucleic acid molecule of (a). In a preferred embodiment, the nucleic acid comprises a DNA encoding the same mature polypeptide encoded by the human protein cDNA in ATCC Deposit No. 203164 (DNA68869-1610).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 128, inclusive of FIG. 302 (SEQ ID NO:420), or (b) the complement of the DNA of (a).

In a further aspect, the invention concerns an isolated nucleic acid molecule having at least 245 nucleotides and produced by hybridizing a test DNA molecule under stringent conditions with (a) a DNA molecule encoding a PRO1385 polypeptide having the sequence of amino acid residues from 1 or about 29 to about 128, inclusive of FIG. 302 (SEQ ID NO:420), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1385 polypeptide, with or without the N-terminal signal sequence and/or the initiating methionine, or is complementary to such encoding nucleic acid molecule. The signal peptide has been tentatively identified as extending from about amino acid position 1 to about amino acid position 28 in the sequence of FIG. 302 (SEQ ID NO:420).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 128, inclusive of FIG. 302 (SEQ ID NO:420), or (b) the complement of the DNA of (a).

Another embodiment is directed to fragments of a PRO1385 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 301 (SEQ ID NO:419).

In another embodiment, the invention provides isolated PRO1385 polypeptide encoded by any of the isolated nucleic acid sequences hereinabove identified.

In a specific aspect, the invention provides isolated native sequence PRO1385 polypeptide, which in certain embodiments, includes an amino acid sequence comprising residues 1 or about 29 to about 128 of FIG. 302 (SEQ ID NO:420).

In another aspect, the invention concerns an isolated PRO1385 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 128, inclusive of FIG. 302 (SEQ ID NO:420).

In a further aspect, the invention concerns an isolated PRO1385 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 128, inclusive of FIG. 302 (SEQ ID NO:420).

In yet another aspect, the invention concerns an isolated PRO1385 polypeptide, comprising the sequence of amino acid residues 1 or about 29 to about 128, inclusive of FIG. 302 (SEQ ID NO:420), or a fragment thereof sufficient to provide a binding site for an anti-PRO1385 antibody. Preferably, the PRO1385 fragment retains a qualitative biological activity of a native PRO1385 polypeptide.

In a still further aspect, the invention provides a polypeptide produced by (i) hybridizing a test DNA molecule under stringent conditions with (a) a DNA molecule encoding a PRO1385 polypeptide having the sequence of amino acid residues from about 1 or about 29 to about 128, inclusive of FIG. 302 (SEQ ID NO:420), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

134. PRO1387

A cDNA clone (DNA68872-1620) has been identified, having homology to nucleic acid encoding myelin, that encodes a novel polypeptide, designated in the present application as "PRO1387".

In one embodiment, the invention provides an isolated nucleic acid molecule comprising DNA encoding a PRO1387 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1387 polypeptide having the sequence of amino acid residues from about 1 or about 20 to about 394, inclusive of FIG. 304 (SEQ ID NO:422), or (b) the complement of the DNA molecule of (a).

In another aspect, the invention concerns an isolated nucleic acid molecule encoding a PRO1387 polypeptide comprising DNA hybridizing to the complement of the nucleic acid between about nucleotides 85 or about 142 and about 1266, inclusive, of FIG. 303 (SEQ ID NO:421). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203160 (DNA68872-1620) or (b) the complement of the nucleic acid molecule of (a). In a preferred embodiment, the nucleic acid comprises a DNA encoding the same mature polypeptide encoded by the human protein cDNA in ATCC Deposit No. 203160 (DNA68872-1620).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 394, inclusive of FIG. 304 (SEQ ID NO:422), or (b) the complement of the DNA of (a).

In a further aspect, the invention concerns an isolated nucleic acid molecule having at least 395 nucleotides and produced by hybridizing a test DNA molecule under stringent conditions with (a) a DNA molecule encoding a PRO1387 polypeptide having the sequence of amino acid residues from 1 or about 20 to about 394, inclusive of FIG. 304 (SEQ ID NO:422), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1387 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 19 in the sequence of FIG. 304 (SEQ ID NO:422). The transmembrane domain has been tentatively identified as extending from about amino acid position 275 to about amino acid position 296 in the PRO1387 amino acid sequence (FIG. 304, SEQ ID NO:422).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 394, inclusive of FIG. 304 (SEQ ID NO:422), or (b) the complement of the DNA of (a).

Another embodiment is directed to fragments of a PRO1387-polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 303 (SEQ ID NO:421).

In another embodiment, the invention provides isolated PRO1387 polypeptide encoded by any of the isolated nucleic acid sequences hereinabove identified.

In a specific aspect, the invention provides isolated native sequence PRO1387 polypeptide, which in certain embodiments, includes an amino acid sequence comprising residues 1 or about 20 to about 394 of FIG. 304 (SEQ ID NO:422).

In another aspect, the invention concerns an isolated PRO1387 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 394, inclusive of FIG. 304 (SEQ ID NO:422).

In a further aspect, the invention concerns an isolated PRO1387 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 394, inclusive of FIG. 304 (SEQ ID NO:422).

In yet another aspect, the invention concerns an isolated PRO1387 polypeptide, comprising the sequence of amino acid residues 1 or about 20 to about 394, inclusive of FIG. 304 (SEQ ID NO:422), or a fragment thereof sufficient to provide a binding site for an anti-PRO1387 antibody. Preferably, the PRO1387 fragment retains a qualitative biological activity of a native PRO1387 polypeptide.

In a still further aspect, the invention provides a polypeptide produced by (i) hybridizing a test DNA molecule under stringent conditions with (a) a DNA molecule encoding a PRO1387 polypeptide having the sequence of amino acid residues from about 1 or about 20 to about 394, inclusive of FIG. 304 (SEQ ID NO:422), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1387 polypeptide. In a particular embodiment, the agonist or antagonist is an anti-PRO1387 antibody.

In a further embodiment, the invention concerns a method of identifying agonists or antagonists of a native PRO1387 polypeptide by contacting the native PRO1387 polypeptide with a candidate molecule and monitoring a biological activity mediated by said polypeptide.

In a still further embodiment, the invention concerns a composition comprising a PRO1387 polypeptide, or an agonist or antagonist as hereinabove defined, in combination with a pharmaceutically acceptable carrier.

135. PRO1384

A cDNA clone, referred to herein as "DNA71159", has been identified that encodes a novel polypeptide having homology to NKG2-D protein designated in the present application as "PRO1384".

In one embodiment, the invention provides an isolated nucleic acid molecule comprising DNA encoding a PRO1384 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1384 polypeptide having the sequence of amino acid residues from about 1 to about 229, inclusive of FIG. 306 (SEQ ID NO:424), or (b) the complement of the DNA molecule of (a).

In another aspect, the invention concerns an isolated nucleic acid molecule encoding a PRO1384 polypeptide comprising DNA hybridizing to the complement of the nucleic acid between about residues 182 and about 868, inclusive, of FIG. 305 (SEQ ID NO:423). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203135 (DNA71159-1617), or (b) the complement of the DNA molecule of (a). In a preferred embodiment, the nucleic acid comprises a DNA encoding the same mature polypeptide encoded by the human protein cDNA in ATCC Deposit No. 203135 (DNA71159-1617).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 229, inclusive of FIG. 306 (SEQ ID NO:424), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1384 polypeptide having the sequence of amino acid residues from about 1 to about 229, inclusive of FIG. 306 (SEQ ID NO:424), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1384 polypeptide with its transmembrane domain deleted or inactivated, or is complementary to such encoding nucleic acid molecule. The transmembrane domain has been tentatively identified as extending from about amino acid position 32 through about amino acid position 57 in the PRO1384 amino acid sequence (FIG. 306, SEQ ID NO:424).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 229, inclusive of FIG. 306 (SEQ ID NO:424), or (b) the complement of the DNA of (a).

Another embodiment is directed to fragments of a PRO1384 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1384 polypeptide encoded by any of the isolated nucleic acid sequences hereinabove defined.

In a specific aspect, the invention provides isolated native sequence PRO1384 polypeptide, which in one embodiment, includes an amino acid sequence comprising residues 1 to 229 of FIG. 306 (SEQ ID NO:424).

In another aspect, the invention concerns an isolated PRO1384 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 229, inclusive of FIG. 306 (SEQ ID NO:424).

In a further aspect, the invention concerns an isolated PRO1384 polypeptide, comprising an amino acid sequence scoring at least about 80% positives, preferably at least about 85% positives, more preferably at least about 90% positives, most preferably at least about 95% positives when compared with the amino acid sequence of residues 1 to 229 of FIG. 306 (SEQ ID NO:424).

In yet another aspect, the invention concerns an isolated PRO1384 polypeptide, comprising the sequence of amino acid residues 1 to about 229, inclusive of FIG. 306 (SEQ ID NO:424), or a fragment thereof sufficient to provide a binding site for an anti-PRO1384 antibody. Preferably, the PRO1384 fragment retains a qualitative biological activity of a native PRO1384 polypeptide.

In a still further aspect, the invention provides a polypeptide produced by (i) hybridizing a test DNA molecule under stringent conditions with (a) a DNA molecule encoding a PRO1384 polypeptide having the sequence of amino acid residues from about 1 to about 229, inclusive of FIG. 306 (SEQ ID NO:424), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1384 polypeptide. In a particular embodiment, the agonist or antagonist is an anti-PRO1384 antibody.

In a further embodiment, the invention concerns a method of identifying agonists or antagonists of a native PRO1384 polypeptide, by contacting the native PRO1384 polypeptide with a candidate molecule and monitoring a biological activity mediated by said polypeptide.

In a still further embodiment, the invention concerns a composition comprising a PRO1384 polypeptide, or an agonist or antagonist as hereinabove defined, in combination with a pharmaceutically acceptable carrier.

136. Additional Embodiments

In other embodiments of the present invention, the invention provides vectors comprising DNA encoding any of the herein described polypeptides. Host cell comprising any such vector are also provided. By way of example, the host cells may be CHO cells, *E. coli*, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which specifically binds to any of the above or below described polypeptides. Optionally, the antibody is a monoclonal antibody, humanized antibody, antibody fragment or single-chain antibody.

In yet other embodiments, the invention provides oligonucleotide probes useful for isolating genomic and cDNA nucleotide sequences or as antisense probes, wherein those probes may be derived from any of the above or below described nucleotide sequences.

In other embodiments, the invention provides an isolated nucleic acid molecule comprising a nucleotide sequence that encodes a PRO polypeptide.

In one aspect, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule comp rising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 20 nucleotides in length, preferably at least about 30 nucleotides in length, more preferably at least about 40 nucleotides in length, yet more preferably at least about 50 nucleotides in length, yet more preferably at least about 60 nucleotides in length, yet more preferably at least about 70 nucleotides in length, yet more preferably at least about 80 nucleotides in length, yet more preferably at least about 90 nucleotides in length, yet more preferably at least about 100 nucleotides in length, yet more preferably at least about 110 nucleotides in length, yet more preferably at least about 120 nucleotides in length, yet more preferably at least about 130 nucleotides in length, yet more preferably at least about 140 nucleotides in length, yet more preferably at least about 150 nucleotides in length, yet more preferably at least about 160 nucleotides in length, yet more preferably at least about 170 nucleotides in length, yet more preferably at least about 180 nucleotides in length, yet more preferably at least about 190 nucleotides in length, yet more preferably at least about 200 nucleotides in length, yet more preferably at least about 250 nucleotides in length, yet more preferably at least about 300 nucleotides in length, yet more preferably at least about 350 nucleotides in length, yet more preferably at least about 400 nucleotides in length, yet more preferably at least about 450 nucleotides in length, yet more preferably at least about 500 nucleotides in length, yet more preferably at least about 600 nucleotides in length, yet more preferably at least about 700 nucleotides in length, yet more preferably at least about 800 nucleotides in length, yet more preferably at least about 900 nucleotides in length and yet more preferably at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to an amino acid sequence encoded by any of the human protein cDNAs deposited with the ATCC as disclosed herein.

In a further aspect, the invention concerns an isolated PRO polypeptide comprising an amino acid sequence scoring at least about 80% positives, preferably at least about 81% positives, more preferably at least about 82% positives, yet more preferably at least about 83% positives, yet more preferably at least about 84% positives, yet more preferably at least about 85% positives, yet more preferably at least about 86% positives, yet more preferably at least about 87% positives, yet more preferably at least about 88% positives, yet more preferably at least about 89% positives, yet more preferably at least about 90% positives, yet more preferably at least about 91% positives, yet more preferably at least about 92% positives, yet more preferably at least about 93% positives, yet more preferably at least about 94% positives, yet more preferably at least about 95% positives, yet more preferably at least about 96% positives, yet more preferably at least about 97% positives, yet more preferably at least about 98% positives and yet more preferably at least about 99% positives when compared with the amino acid sequence of a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

BRIEF DESCRIPTION OF THE DRAWINGS

FIG. 1 shows a nucleotide sequence (SEQ ID NO:1) of a native sequence PRO281 (UNQ244) cDNA, wherein SEQ ID NO:1 is a clone designated herein as "DNA16422-1209".

FIG. 2 shows the amino acid sequence (SEQ ID NO:2) derived from the coding sequence of SEQ ID NO:1 shown in FIG. 1.

FIG. 3 shows a nucleotide sequence (SEQ ID NO:5) of a native sequence PRO276 (UNQ243) cDNA, wherein SEQ ID NO:5 is a clone designated herein as "DNA16435-1208".

FIG. 4 shows the amino acid sequence (SEQ ID NO:6) derived from the coding sequence of SEQ ID NO:5 shown in FIG. 3.

FIG. 5 shows a nucleotide sequence (SEQ ID NO:7) of a native sequence PRO189 (UNQ163) cDNA, wherein SEQ ID NO:7 is a clone designated herein as "DNA21624-1391".

FIG. 6 shows the amino acid sequence (SEQ ID NO:8) derived from the coding sequence of SEQ ID NO:7 shown in FIG. 5.

FIG. 7 shows a nucleotide sequence designated herein as DNA14187 (SEQ ID NO:9).

FIG. 8 shows a nucleotide sequence (SEQ ID NO:13) of a native sequence PRO190 (UNQ164) cDNA, wherein SEQ ID NO:13 is a clone designated herein as "DNA23334-1392".

FIG. 9 shows the amino acid sequence (SEQ ID NO:14) derived from the coding sequence of SEQ ID NO:13 shown in FIG. 8.

FIG. 10 shows a nucleotide sequence designated herein as DNA14232 (SEQ ID NO:15).

FIG. 11 shows a nucleotide sequence (SEQ ID NO:19) of a native sequence PRO341 (UNQ300) cDNA, wherein SEQ ID NO:19 is a clone designated herein as "DNA26288-1239".

FIG. 12 shows the amino acid sequence (SEQ ID NO:20) derived from the coding sequence of SEQ ID NO:19 shown in FIG. 11.

FIG. 13 shows a nucleotide sequence designated herein as DNA12920 (SEQ ID NO:21).

FIG. 14 shows a nucleotide sequence (SEQ ID NO:22) of a native sequence PRO180 (UNQ154) cDNA, wherein SEQ ID NO:22 is a clone designated herein as "DNA26843-1389".

FIG. 15 shows the amino acid sequence (SEQ ID NO:23) derived from the coding sequence of SEQ ID NO:22 shown in FIG. 14.

FIG. 16 shows a nucleotide sequence designated herein as DNA12922 (SEQ ID NO:24).

FIG. 17 shows a nucleotide sequence (SEQ ID NO:27) of a native sequence PRO194 (UNQ168) cDNA, wherein SEQ ID NO:27 is a clone designated herein as "DNA26844-1394".

FIG. 18 shows the amino acid sequence (SEQ ID NO:28) derived from the coding sequence of SEQ ID NO:27 shown in FIG. 17.

FIG. 19 shows a nucleotide sequence (SEQ ID NO:29) of a native sequence PRO203 (UNQ177) cDNA, wherein SEQ ID NO:29 is a clone designated herein as "DNA30862-1396".

FIG. 20 shows the amino acid sequence (SEQ ID NO:30) derived from the coding sequence of SEQ ID NO:29 shown in FIG. 19.

FIG. 21 shows a nucleotide sequence designated herein as DNA15618 (SEQ ID NO:31).

FIG. 22 shows a nucleotide sequence (SEQ ID NO:32) of a native sequence PRO290 (UNQ253) cDNA, wherein SEQ ID NO:32 is a clone designated herein as "DNA35680-1212".

FIG. 23 shows the amino acid sequence (SEQ ID NO:33) derived from the coding sequence of SEQ ID NO:32 shown in FIG. 22.

FIG. 24 shows a nucleotide sequence (SEQ ID NO:35) of a native sequence PRO874 (UNQ441) cDNA, wherein SEQ ID NO:35 is a clone designated herein as "DNA40621-1440".

FIG. 25 shows the amino acid sequence (SEQ ID NO:36) derived from the coding sequence of SEQ ID NO:35 shown in FIG. 24.

FIG. 26 shows a nucleotide sequence (SEQ ID NO:40) of a native sequence PRO710 (UNQ374) cDNA, wherein SEQ ID NO:40 is a clone designated herein as "DNA44161-1434".

FIG. 27 shows the amino acid sequence (SEQ ID NO:41) derived from the coding sequence of SEQ ID NO:40 shown in FIG. 26.

FIG. 28 shows a nucleotide sequence designated herein as DNA38190 (SEQ ID NO:42).

FIG. 29 shows a nucleotide sequence (SEQ ID NO:46) of a native sequence PRO1151 (UNQ581) cDNA, wherein SEQ ID NO:46 is a clone designated herein as "DNA44694-1500".

FIG. 30 shows the amino acid sequence (SEQ ID NO:47) derived from the coding sequence of SEQ ID NO:46 shown in FIG. 29.

FIG. 31 shows a nucleotide sequence (SEQ ID NO:51) of a native sequence PRO1282 (UNQ652) cDNA, wherein SEQ ID NO:51 is a clone designated herein as "DNA45495-1550".

FIG. 32 shows the amino acid sequence (SEQ ID NO:52) derived from the coding sequence of SEQ ID NO:51 shown in FIG. 31.

FIG. 33 shows a nucleotide sequence (SEQ ID NO:56) of a native sequence PRO358 cDNA, wherein SEQ ID NO:56 is a clone designated herein as "DNA47361-1154."

FIG. 34 shows the amino acid sequence (SEQ ID NO:57) derived from the coding sequence of SEQ ID NO:56 shown in FIG. 33.

FIG. 35 shows a nucleotide sequence (SEQ ID NO:61) of a native sequence PRO1310 cDNA, wherein SEQ ID NO:61 is a clone designated herein as "DNA47394-1572.

FIG. 36 shows the amino acid sequence (SEQ ID NO:62) derived from the coding sequence of SEQ ID NO:61 shown in FIG. 35.

FIG. 37 shows a nucleotide sequence (SEQ ID NO:66) of a native sequence PRO698 (UNQ362) cDNA, wherein SEQ ID NO:66 is a clone designated herein as "DNA48320-1433".

FIG. 38 shows the amino acid sequence (SEQ ID NO:67) derived from the coding sequence of SEQ ID NO:66 shown in FIG. 37.

FIG. 39 shows a nucleotide sequence designated herein as DNA39906 (SEQ ID NO:68).

FIG. 40 shows a nucleotide sequence (SEQ ID NO:72) of a native sequence PRO732 (UNQ396) cDNA, wherein SEQ ID NO:72 is a clone designated herein as "DNA48334-1435".

FIG. 41 shows the amino acid sequence (SEQ ID NO:73) derived from the coding sequence of SEQ ID NO:72 shown in FIG. 40.

FIG. 42 shows a nucleotide sequence designated herein as DNA20239 (SEQ ID NO:74).

FIG. 43 shows a nucleotide sequence designated herein as DNA38050 (SEQ ID NO:75).

FIG. 44 shows a nucleotide sequence designated herein as DNA40683 (SEQ ID NO:76).

FIG. 45 shows a nucleotide sequence designated herein as DNA42580 (SEQ ID NO:77).

FIG. 46 shows a nucleotide sequence (SEQ ID NO:83) of a native sequence PRO1120 (UNQ559) cDNA, wherein SEQ ID NO:83 is a clone designated herein as "DNA48606-1479".

FIG. 47 shows the amino acid sequence (SEQ ID NO:84) derived from the coding sequence of SEQ ID NO:83 shown in FIG. 46.

FIG. 48 shows a nucleotide sequence (SEQ ID NO:94) of a native sequence PRO537 (UNQ338) cDNA, wherein SEQ ID NO:94 is a clone designated herein as "DNA49141-1431".

FIG. 49 shows the amino acid sequence (SEQ ID NO:95) derived from the coding sequence of SEQ ID NO:94 shown in FIG. 48.

FIG. 50 shows a nucleotide sequence (SEQ ID NO:96) of a native sequence PRO536 (UNQ337) cDNA, wherein SEQ ID NO:96 is a clone designated herein as "DNA49142-1430".

FIG. 51 shows the amino acid sequence (SEQ ID NO:97) derived from the coding sequence of SEQ ID NO:96 shown in FIG. 50.

FIG. 52 shows a nucleotide sequence (SEQ ID NO:98) of a native sequence PRO535 (UNQ336) cDNA, wherein SEQ ID NO:98 is a clone designated herein as "DNA49143-1429".

FIG. 53 shows the amino acid sequence (SEQ ID NO:99) derived from the coding sequence of SEQ ID NO:98 shown in FIG. 52.

FIG. 54 shows a nucleotide sequence designated herein as DNA30861 (SEQ ID NO:100).

FIG. 55 shows a nucleotide sequence designated herein as DNA36351 (SEQ ID NO:101).

FIG. 56 shows a nucleotide sequence (SEQ ID NO:102) of a native sequence PRO718 (UNQ386) cDNA, wherein SEQ ID NO:102 is a clone designated herein as "DNA49647-1398".

FIG. 57 shows the amino acid sequence (SEQ ID NO:103) derived from the coding sequence of SEQ ID NO:102 shown in FIG. 56.

FIG. 58 shows a nucleotide sequence designated herein as DNA15386 (SEQ ID NO:104).

FIG. 59 shows a nucleotide sequence designated herein as DNA16630 (SEQ ID NO:105).

FIG. 60 shows a nucleotide sequence designated herein as DNA16829 (SEQ ID NO:106).

FIG. 61 shows a nucleotide sequence designated herein as DNA28357 (SEQ ID NO:107).

FIG. 62 shows a nucleotide sequence designated herein as DNA43512 (SEQ ID NO:108).

FIG. 63 shows a nucleotide sequence (SEQ ID NO:112) of a native sequence PRO872 (UNQ439) cDNA, wherein SEQ ID NO:112 is a clone designated herein as "DNA49819-1439".

FIG. 64 shows the amino acid sequence (SEQ ID NO:113) derived from the coding sequence of SEQ ID NO:112 shown in FIG. 63.

FIG. 65 shows a nucleotide sequence (SEQ ID NO:114) of a native sequence PRO1063 (UNQ128) cDNA, wherein SEQ ID NO:114 is a clone designated herein as "DNA49820-1427".

FIG. 66 shows the amino acid sequence (SEQ ID NO:115) derived from the coding sequence of SEQ ID NO:114 shown in FIG. 65.

FIG. 67 shows a nucleotide sequence (SEQ ID NO:116) of a native sequence PRO619 (UNQ355) cDNA, wherein SEQ ID NO:116 is a clone designated herein as "DNA49821-1562".

FIG. 68 shows the amino acid sequence (SEQ ID NO:117) derived from the coding sequence of SEQ ID NO:116 shown in FIG. 67.

FIG. 69 shows a nucleotide sequence (SEQ ID NO:118) of a native sequence PRO943 (UNQ480) cDNA, wherein SEQ ID NO:118 is a clone designated herein as "DNA52192-1369".

FIG. 70 shows the amino acid sequence (SEQ ID NO:119) derived from the coding sequence of SEQ ID NO:118 shown in FIG. 69.

FIG. 71 shows a nucleotide sequence (SEQ ID NO:123) of a native sequence PRO1188 (UNQ602) cDNA, wherein SEQ ID NO:123 is a clone designated herein as "DNA52598-1518".

FIG. 72 shows the amino acid sequence (SEQ ID NO:124) derived from the coding sequence of SEQ ID NO:123 shown in FIG. 71.

FIG. 73 shows a nucleotide sequence (SEQ ID NO:128) of a native sequence PRO1133 (UNQ571) cDNA, wherein SEQ ID NO:128 is a clone designated herein as "DNA53913-1490".

FIG. 74 shows the amino acid sequence (SEQ ID NO:129) derived from the coding sequence of SEQ ID NO:128 shown in FIG. 73.

FIG. 75 shows a nucleotide sequence (SEQ ID NO:134) of a native sequence PRO784 (UNQ459) cDNA, wherein SEQ ID NO:134 is a clone designated herein as "DNA53978-1443".

FIG. 76 shows the amino acid sequence (SEQ ID NO:135) derived from the coding sequence of SEQ ID NO:134 shown in FIG. 75.

FIG. 77 shows a nucleotide sequence designated herein as DNA44661 (SEQ ID NO:136).

FIG. 78 shows a nucleotide sequence (SEQ ID NO:137) of a native sequence PRO783 (UNQ458) cDNA, wherein SEQ ID NO:137 is a clone designated herein as "DNA53996-1442".

FIG. 79 shows the amino acid sequence (SEQ ID NO:138) derived from the coding sequence of SEQ ID NO:137 shown in FIG. 78.

FIG. 80 shows a nucleotide sequence designated herein as DNA45201 (SEQ ID NO:139).

FIG. 81 shows a nucleotide sequence designated herein as DNA14575 (SEQ ID NO:140).

FIG. 82 shows a nucleotide sequence (SEQ ID NO:145) of a native sequence PRO820 (UNQ503) cDNA, wherein SEQ ID NO:145 is a clone designated herein as "DNA56041-1416".

FIG. 83 shows the amino acid sequence (SEQ ID NO:146) derived from the coding sequence of SEQ ID NO:145 shown in FIG. 82.

FIG. 84 shows a nucleotide sequence (SEQ ID NO:147) of a native sequence PRO1080 (UNQ537) cDNA, wherein SEQ ID NO:147 is a clone designated herein as "DNA56047-1456".

FIG. 85 shows the amino acid sequence (SEQ ID NO:148) derived from the coding sequence of SEQ ID NO:147 shown in FIG. 84.

FIG. 86 shows a nucleotide sequence designated herein as DNA36527 (SEQ ID NO:149).

FIG. 87 shows a nucleotide sequence (SEQ ID NO:150) of a native sequence PRO1079 (UNQ536) cDNA, wherein SEQ ID NO:150 is a clone designated herein as "DNA56050-1455".

FIG. 88 shows the amino acid sequence (SEQ ID NO:151) derived from the coding sequence of SEQ ID NO:150 shown in FIG. 87.

FIG. 89 shows a nucleotide sequence (SEQ ID NO:152) of a native sequence PRO793 (UNQ432) cDNA, wherein SEQ ID NO:152 is a clone designated herein as "DNA56110-1437".

FIG. 90 shows the amino acid sequence (SEQ ID NO:153) derived from the coding sequence of SEQ ID NO:152 shown in FIG. 89.

FIG. 91 shows a nucleotide sequence designated herein as DNA50177 (SEQ ID NO:154).

FIG. 92 shows a nucleotide sequence (SEQ ID NO:155) of a native sequence PRO1016 (UNQ499) cDNA, wherein SEQ ID NO:155 is a clone designated herein as "DNA56113-1378".

FIG. 93 shows the amino acid sequence (SEQ ID NO:156) derived from the coding sequence of SEQ ID NO:155 shown in FIG. 92.

FIG. 94 shows a nucleotide sequence (SEQ ID NO:157) of a native sequence PRO1013 (UNQ496) cDNA, wherein SEQ ID NO:157 is a clone designated herein as "DNA56410-1414".

FIG. 95 shows the amino acid sequence (SEQ ID NO:158) derived from the coding sequence of SEQ ID NO:157 shown in FIG. 94.

FIG. 96 shows a nucleotide sequence (SEQ ID NO:159) of a native sequence PRO937 (UNQ474) cDNA, wherein SEQ ID NO:159 is a clone designated herein as "DNA56436-1448".

FIG. 97 shows the amino acid sequence (SEQ ID NO:160) derived from the coding sequence of SEQ ID NO:159 shown in FIG. 96.

FIG. 98 shows a nucleotide sequence (SEQ ID NO:164) of a native sequence PRO842 (UNQ473) cDNA, wherein SEQ ID NO:164 is a clone designated herein as "DNA56855-1447".

FIG. 99 shows the amino acid sequence (SEQ ID NO:165) derived from the coding sequence of SEQ ID NO:164 shown in FIG. 98.

FIG. 100 shows a nucleotide sequence (SEQ ID NO:166) of a native sequence PRO839 (UNQ472) cDNA, wherein SEQ ID NO:166 is a clone designated herein as "DNA56859-1445".

FIG. 101 shows the amino acid sequence (SEQ ID NO:167) derived from the coding sequence of SEQ ID NO:166 shown in FIG. 100.

FIG. 102 shows a nucleotide sequence (SEQ ID NO:168) of a native sequence PRO1180 (UNQ594) cDNA, wherein SEQ ID NO:168 is a clone designated herein as "DNA56860-1510".

FIG. 103 shows the amino acid sequence (SEQ ID NO:169) derived from the coding sequence of SEQ ID NO:168 shown in FIG. 102.

FIG. 104 shows a nucleotide sequence (SEQ ID NO:170) of a native sequence PRO1134 (UNQ572) cDNA, wherein SEQ ID NO:170 is a clone designated herein as "DNA56865-1491".

FIG. 105 shows the amino acid sequence (SEQ ID NO:171) derived from the coding sequence of SEQ ID NO:170 shown in FIG. 104.

FIG. 106 shows a nucleotide sequence designated herein as DNA52352 (SEQ ID NO:172).

FIG. 107 shows a nucleotide sequence designated herein as DNA55725 (SEQ ID NO:173).

FIG. 108 shows a nucleotide sequence (SEQ ID NO:174) of a native sequence PRO830 (UNQ470) cDNA, wherein SEQ ID NO:174 is a clone designated herein as "DNA56866-1342".

FIG. 109 shows the amino acid sequence (SEQ ID NO:175) derived from the coding sequence of SEQ ID NO:174 shown in FIG. 108.

FIG. 110 shows a nucleotide sequence (SEQ ID NO:176) of a native sequence PRO1115 (UNQ558) cDNA, wherein SEQ ID NO:176 is a clone designated herein as "DNA56868-1478".

FIG. 111 shows the amino acid sequence (SEQ ID NO:177) derived from the coding sequence of SEQ ID NO:176 shown in FIG. 110.

FIG. 112 shows a nucleotide sequence (SEQ ID NO:178) of a native sequence PRO1277 (UNQ647) cDNA, wherein SEQ ID NO:178 is a clone designated herein as "DNA56869-1545".

FIG. 113 shows the amino acid sequence (SEQ ID NO:179) derived from the coding sequence of SEQ ID NO:178 shown in FIG. 112.

FIG. 114 shows a nucleotide sequence (SEQ ID NO:180) of a native sequence PRO1135 (UNQ573) cDNA, wherein SEQ ID NO:180 is a clone designated herein as "DNA56870-1492".

FIG. 115 shows the amino acid sequence (SEQ ID NO:181) derived from the coding sequence of SEQ ID NO:180 shown in FIG. 114.

FIG. 116 shows a nucleotide sequence (SEQ ID NO:182) of a native sequence PRO114 (UNQ557) cDNA, wherein SEQ ID NO:182 is a clone designated herein as "DNA57033-1403".

FIG. 117 shows the amino acid sequence (SEQ ID NO:183) derived from the coding sequence of SEQ ID NO:182 shown in FIG. 116.

FIG. 118 shows a nucleotide sequence designated herein as DNA48466 (SEQ ID NO:184).

FIG. 119 shows a nucleotide sequence (SEQ ID NO:188) of a native sequence PRO828 (UNQ469) cDNA, wherein SEQ ID NO:188 is a clone designated herein as "DNA57037-1444".

FIG. 120 shows the amino acid sequence (SEQ ID NO:189) derived from the coding sequence of SEQ ID NO:188 shown in FIG. 119.

FIG. 121 shows a nucleotide sequence (SEQ ID NO:193) of a native sequence PRO1009 (UNQ493) cDNA, wherein SEQ ID NO:193 is a clone designated herein as "DNA57129-1413".

FIG. 122 shows the amino acid sequence (SEQ ID NO:194) derived from the coding sequence of SEQ ID NO:193 shown in FIG. 121.

FIG. 123 shows a nucleotide sequence designated herein as DNA50853 (SEQ ID NO:195).

FIG. 124 shows a nucleotide sequence (SEQ ID NO:196) of a native sequence PRO1007 (UNQ491) cDNA, wherein SEQ ID NO:196 is a clone designated herein as "DNA57690-1374".

FIG. 125 shows the amino acid sequence (SEQ ID NO:197) derived from the coding sequence of SEQ ID NO:196 shown in FIG. 124.

FIG. 126 shows a nucleotide sequence (SEQ ID NO:198) of a native sequence PRO1056 (UNQ521) cDNA, wherein SEQ ID NO:198 is a clone designated herein as "DNA57693-1424".

FIG. 127 shows the amino acid sequence (SEQ ID NO:199) derived from the coding sequence of SEQ ID NO:198 shown in FIG. 126.

FIG. 128 shows a nucleotide sequence (SEQ ID NO:200) of a native sequence PRO826 (UNQ467) cDNA, wherein SEQ ID NO:200 is a clone designated herein as "DNA57694-1341".

FIG. 129 shows the amino acid sequence (SEQ ID NO:201) derived from the coding sequence of SEQ ID NO:200 shown in FIG. 128.

FIG. 130 shows a nucleotide sequence (SEQ ID NO:202) of a native sequence PRO819 (UNQ466) cDNA, wherein SEQ ID NO:202 is a clone designated herein as "DNA57695-1340".

FIG. 131 shows the amino acid sequence (SEQ ID NO:203) derived from the coding sequence of SEQ ID NO:202 shown in FIG. 130.

FIG. 132 shows a nucleotide sequence (SEQ ID NO:204) of a native sequence PRO1006 (UNQ490) cDNA, wherein SEQ ID NO:204 is a clone designated herein as "DNA57699-1412".

FIG. 133 shows the amino acid sequence (SEQ ID NO:205) derived from the coding sequence of SEQ ID NO:204 shown in FIG. 132.

FIG. 134 shows a nucleotide sequence (SEQ ID NO:206) of a native sequence PRO1112 (UNQ555) cDNA, wherein SEQ ID NO:206 is a clone designated herein as "DNA57702-1476".

FIG. 135 shows the amino acid sequence (SEQ ID NO:207) derived from the coding sequence of SEQ ID NO:206 shown in FIG. 134.

FIG. 136 shows a nucleotide sequence (SEQ ID NO:208) of a native sequence PRO1074 (UNQ531) cDNA, wherein SEQ ID NO:208 is a clone designated herein as "DNA57704-1452".

FIG. 137 shows the amino acid sequence (SEQ ID NO:209) derived from the coding sequence of SEQ ID NO:208 shown in FIG. 136.

FIG. 138 shows a nucleotide sequence (SEQ ID NO:210) of a native sequence PRO1005 (UNQ489) cDNA, wherein SEQ ID NO:210 is a clone designated herein as "DNA57708-1005".

FIG. 139 shows the amino acid sequence (SEQ ID NO:211) derived from the coding sequence of SEQ ID NO:210 shown in FIG. 138.

FIG. 140 shows a nucleotide sequence (SEQ ID NO:212) of a native sequence PRO1073 (UNQ530) cDNA, wherein SEQ ID NO:212 is a clone designated herein as "DNA57710-1451".

FIG. 141 shows the amino acid sequence (SEQ ID NO:213) derived from the coding sequence of SEQ ID NO:212 shown in FIG. 140.

FIG. 142 shows a nucleotide sequence designated herein as DNA55938 (SEQ ID NO:214).

FIG. 143 shows a nucleotide sequence (SEQ ID NO:215) of a native sequence PRO1152 (UNQ582) cDNA, wherein SEQ ID NO:215 is a clone designated herein as "DNA57711-1501".

FIG. 144 shows the amino acid sequence (SEQ ID NO:216) derived from the coding sequence of SEQ ID NO:215 shown in FIG. 143.

FIG. 145 shows a nucleotide sequence designated herein as DNA55807 (SEQ ID NO:217).

FIG. 146 shows a nucleotide sequence (SEQ ID NO:218) of a native sequence PRO1136 (UNQ574) cDNA, wherein SEQ ID NO:218 is a clone designated herein as "DNA57827-1493".

FIG. 147 shows the amino acid sequence (SEQ ID NO:219) derived from the coding sequence of SEQ ID NO:218 shown in FIG. 146.

FIG. 148 shows a nucleotide sequence (SEQ ID NO:220) of a native sequence PRO813 (UNQ465) cDNA, wherein SEQ ID NO:220 is a clone designated herein as "DNA57834-1339".

FIG. 149 shows the amino acid sequence (SEQ ID NO:221) derived from the coding sequence of SEQ ID NO:220 shown in FIG. 148.

FIG. 150 shows a nucleotide sequence (SEQ ID NO:222) of a native sequence PRO809 (UNQ464) cDNA, wherein SEQ ID NO:222 is a clone designated herein as "DNA57836-1338".

FIG. 151 shows the amino acid sequence (SEQ ID NO:223) derived from the coding sequence of SEQ ID NO:222 shown in FIG. 150.

FIG. 152 shows a nucleotide sequence (SEQ ID NO:224) of a native sequence PRO791 (UNQ463) cDNA, wherein SEQ ID NO:224 is a clone designated herein as "DNA57838-1337".

FIG. 153 shows the amino acid sequence (SEQ ID NO:225) derived from the coding sequence of SEQ ID NO:224 shown in FIG. 152.

FIG. 154 shows a nucleotide sequence (SEQ ID NO:226) of a native sequence PRO1004 (UNQ488) cDNA, wherein SEQ ID NO:226 is a clone designated herein as "DNA57844-1410".

FIG. 155 shows the amino acid sequence (SEQ ID NO:227) derived from the coding sequence of SEQ ID NO:226 shown in FIG. 154.

FIG. 156 shows a nucleotide sequence (SEQ ID NO:228) of a native sequence PRO1111 (UNQ554) cDNA, wherein SEQ ID NO:228 is a clone designated herein as "DNA58721-1475".

FIG. 157 shows the amino acid sequence (SEQ ID NO:229) derived from the coding sequence of SEQ ID NO:228 shown in FIG. 156.

FIG. 158 shows a nucleotide sequence (SEQ ID NO:230) of a native sequence PRO1344 (UNQ699) cDNA, wherein SEQ ID NO:230 is a clone designated herein as "DNA58723-1588".

FIG. 159 shows the amino acid sequence (SEQ ID NO:231) derived from the coding sequence of SEQ ID NO:230 shown in FIG. 158.

FIG. 160 shows a nucleotide sequence (SEQ ID NO:235) of a native sequence PRO1109 (UNQ552) cDNA, wherein SEQ ID NO:235 is a clone designated herein as "DNA58737-1473".

FIG. 161 shows the amino acid sequence (SEQ ID NO:236) derived from the coding sequence of SEQ ID NO:235 shown in FIG. 160.

FIG. 162 shows a nucleotide sequence (SEQ ID NO:240) of a native sequence PRO1383 (UNQ719) cDNA, wherein SEQ ID NO:240 is a clone designated herein as "DNA58743-1609".

FIG. 163 shows the amino acid sequence (SEQ ID NO:241) derived from the coding sequence of SEQ ID NO:240 shown in FIG. 162.

FIG. 164 shows a nucleotide sequence (SEQ ID NO:245) of a native sequence PRO1003 (UNQ487) cDNA, wherein SEQ ID NO:245 is a clone designated herein as "DNA58846-1409".

FIG. 165 shows the amino acid sequence (SEQ ID NO:246) derived from the coding sequence of SEQ ID NO:245 shown in FIG. 164.

FIG. 166 shows a nucleotide sequence (SEQ ID NO:247) of a native sequence PRO1108 (UNQ551) cDNA, wherein SEQ ID NO:247 is a clone designated herein as "DNA58848-1472".

FIG. 167 shows the amino acid sequence (SEQ ID NO:248) derived from the coding sequence of SEQ ID NO:247 shown in FIG. 166.

FIG. 168 shows a nucleotide sequence (SEQ ID NO:249) of a native sequence PRO1137 (UNQ575) cDNA, wherein SEQ ID NO:249 is a clone designated herein as "DNA58849-1494".

FIG. 169 shows the amino acid sequence (SEQ ID NO:250) derived from the coding sequence of SEQ ID NO:249 shown in FIG. 168.

FIG. 170 shows a nucleotide sequence (SEQ ID NO:252) of a native sequence PRO1138 (UNQ576) cDNA, wherein SEQ ID NO:252 is a clone designated herein as "DNA58850-1495".

FIG. 171 shows the amino acid sequence (SEQ ID NO:253) derived from the coding sequence of SEQ ID NO:252 shown in FIG. 170.

FIG. 172 shows a nucleotide sequence designated herein as DNA49140 (SEQ ID NO:254).

FIG. 173 shows a nucleotide sequence (SEQ ID NO:255) of a native sequence PRO1054 (UNQ519) cDNA, wherein SEQ ID NO:255 is a clone designated herein as "DNA58853-1423".

FIG. 174 shows the amino acid sequence (SEQ ID NO:256) derived from the coding sequence of SEQ ID NO:255 shown in FIG. 173.

FIG. 175 shows a nucleotide sequence (SEQ ID NO:257) of a native sequence PRO994 (UNQ518) cDNA, wherein SEQ ID NO:257 is a clone designated herein as "DNA58855-1422".

FIG. 176 shows the amino acid sequence (SEQ ID NO:258) derived from the coding sequence of SEQ ID NO:257 shown in FIG. 175.

FIG. 177 shows a nucleotide sequence (SEQ ID NO:259) of a native sequence PRO812 (UNQ517) cDNA, wherein SEQ ID NO:259 is a clone designated herein as "DNA59205-1421".

FIG. 178 shows the amino acid sequence (SEQ ID NO:260) derived from the coding sequence of SEQ ID NO:259 shown in FIG. 177.

FIG. 179 shows a nucleotide sequence (SEQ ID NO:261) of a native sequence PRO1069 (UNQ526) cDNA, wherein SEQ ID NO:261 is a clone designated herein as "DNA59211-1450".

FIG. 180 shows the amino acid sequence (SEQ ID NO:262) derived from the coding sequence of SEQ ID NO:261 shown in FIG. 179.

FIG. 181 shows a nucleotide sequence (SEQ ID NO:263) of a native sequence PRO1129 (UNQ568) cDNA, wherein SEQ ID NO:263 is a clone designated herein as "DNA59213-1487".

FIG. 182 shows the amino acid sequence (SEQ ID NO:264) derived from the coding sequence of SEQ ID NO:263 shown in FIG. 181.

FIG. 183 shows a nucleotide sequence (SEQ ID NO:265) of a native sequence PRO1068 (UNQ525) cDNA, wherein SEQ ID NO:265 is a clone designated herein as "DNA59214-1449".

FIG. 184 shows the amino acid sequence (SEQ ID NO:266) derived from the coding sequence of SEQ ID NO:265 shown in FIG. 183.

FIG. 185 shows a nucleotide sequence (SEQ ID NO:267) of a native sequence PRO1066 (UNQ524) cDNA, wherein SEQ ID NO:267 is a clone designated herein as "DNA59215-1425".

FIG. 186 shows the amino acid sequence (SEQ ID NO:268) derived from the coding sequence of SEQ ID NO:267 shown in FIG. 185.

FIG. 187 shows a nucleotide sequence (SEQ ID NO:269) of a native sequence PRO1184 (UNQ598) cDNA, wherein SEQ ID NO:269 is a clone designated herein as "DNA59220-1514".

FIG. 188 shows the amino acid sequence (SEQ ID NO:270) derived from the coding sequence of SEQ ID NO:269 shown in FIG. 187.

FIG. 189 shows a nucleotide sequence (SEQ ID NO:271) of a native sequence PRO1360 (UNQ709) cDNA, wherein SEQ ID NO:271 is a clone designated herein as "DNA59488-1603".

FIG. 190 shows the amino acid sequence (SEQ ID NO:272) derived from the coding sequence of SEQ ID NO:271 shown in FIG. 189.

FIG. 191 shows a nucleotide sequence (SEQ ID NO:273) of a native sequence PRO1029 (UNQ514) cDNA, wherein SEQ ID NO:273 is a clone designated herein as "DNA59493-1420".

FIG. 192 shows the amino acid sequence (SEQ ID NO:274) derived from the coding sequence of SEQ ID NO:273 shown in FIG. 191.

FIG. 193 shows a nucleotide sequence (SEQ ID NO:275) of a native sequence PRO1139 (UNQ577) cDNA, wherein SEQ ID NO:275 is a clone designated herein as "DNA59497-1496".

FIG. 194 shows the amino acid sequence (SEQ ID NO:276) derived from the coding sequence of SEQ ID NO:275 shown in FIG. 193.

FIG. 195 shows a nucleotide sequence (SEQ ID NO:277) of a native sequence PRO1309 (UNQ675) cDNA, wherein SEQ ID NO:277 is a clone designated herein as "DNA59588-1571".

FIG. 196 shows the amino acid sequence (SEQ ID NO:278) derived from the coding sequence of SEQ ID NO:277 shown in FIG. 195.

FIG. 197 shows a nucleotide sequence (SEQ ID NO:280) of a native sequence PRO1028 (UNQ513) cDNA, wherein SEQ ID NO:280 is a clone designated herein as "DNA59603-1419".

FIG. 198 shows the amino acid sequence (SEQ ID NO:281) derived from the coding sequence of SEQ ID NO:280 shown in FIG. 197.

FIG. 199 shows a nucleotide sequence (SEQ ID NO:282) of a native sequence PRO1027 (UNQ512) cDNA, wherein SEQ ID NO:282 is a clone designated herein as "DNA59605-1418".

FIG. 200 shows the amino acid sequence (SEQ ID NO:283) derived from the coding sequence of SEQ ID NO:282 shown in FIG. 199.

FIG. 201 shows a nucleotide sequence (SEQ ID NO:284) of a native sequence PRO1107 (UNQ550) cDNA, wherein SEQ ID NO:284 is a clone designated herein as "DNA59606-1471".

FIG. 202 shows the amino acid sequence (SEQ ID NO:285) derived from the coding sequence of SEQ ID NO:284 shown in FIG. 201.

FIG. 203 shows a nucleotide sequence (SEQ ID NO:286) of a native sequence PRO1140 (UNQ578) cDNA, wherein SEQ ID NO:286 is a clone designated herein as "DNA59607-1497".

FIG. 204 shows the amino acid sequence (SEQ ID NO:287) derived from the coding sequence of SEQ ID NO:286 shown in FIG. 203.

FIG. 205 shows a nucleotide sequence (SEQ ID NO:288) of a native sequence PRO1106 (UNQ549) cDNA, wherein SEQ ID NO:288 is a clone designated herein as "DNA59609-1470".

FIG. 206 shows the amino acid sequence (SEQ ID NO:289) derived from the coding sequence of SEQ ID NO:288 shown in FIG. 205.

FIG. 207 shows a nucleotide sequence (SEQ ID NO:290) of a native sequence PRO1291 (UNQ659) cDNA, wherein SEQ ID NO:290 is a clone designated herein as "DNA59610-1556".

FIG. 208 shows the amino acid sequence (SEQ ID NO:291) derived from the coding sequence of SEQ ID NO:290 shown in FIG. 207.

FIG. 209 shows a nucleotide sequence (SEQ ID NO:292) of a native sequence PRO1105 (UNQ548) cDNA, wherein SEQ ID NO:292 is a clone designated herein as "DNA59612-1466".

FIG. 210 shows the amino acid sequence (SEQ ID NO:293) derived from the coding sequence of SEQ ID NO:292 shown in FIG. 209.

FIG. 211 shows a nucleotide sequence (SEQ ID NO:294) of a native sequence PRO511 (UNQ511) cDNA, wherein SEQ ID NO:294 is a clone designated herein as "DNA59613-1417".

FIG. 212 shows the amino acid sequence (SEQ ID NO:295) derived from the coding sequence of SEQ ID NO:294 shown in FIG. 211.

FIG. 213 shows a nucleotide sequence (SEQ ID NO:296) of a native sequence PRO1104 (UNQ547) cDNA, wherein SEQ ID NO:296 is a clone designated herein as "DNA59616-1465".

FIG. 214 shows the amino acid sequence (SEQ ID NO:297) derived from the coding sequence of SEQ ID NO:296 shown in FIG. 213.

FIG. 215 shows a nucleotide sequence (SEQ ID NO:298) of a native sequence PRO1100 (UNQ546) cDNA, wherein SEQ ID NO:298 is a clone designated herein as "DNA59619-1464".

FIG. 216 shows the amino acid sequence (SEQ ID NO:299) derived from the coding sequence of SEQ ID NO:298 shown in FIG. 215.

FIG. 217 shows a nucleotide sequence (SEQ ID NO:300) of a native sequence PRO836 (UNQ545) cDNA, wherein SEQ ID NO:300 is a clone designated herein as "DNA59620-1463".

FIG. 218 shows the amino acid sequence (SEQ ID NO:301) derived from the coding sequence of SEQ ID NO:300 shown in FIG. 217.

FIG. 219 shows a nucleotide sequence (SEQ ID NO:302) of a native sequence PRO1141 (UNQ579) cDNA, wherein SEQ ID NO:302 is a clone designated herein as "DNA59625-1498".

FIG. 220 shows the amino acid sequence (SEQ ID NO:303) derived from the coding sequence of SEQ ID NO:302 shown in FIG. 219.

FIG. 221 shows a nucleotide sequence designated herein as DNA33128 (SEQ ID NO:304).

FIG. 222 shows a nucleotide sequence designated herein as DNA34256 (SEQ ID NO:305).

FIG. 223 shows a nucleotide sequence designated herein as DNA47941 (SEQ ID NO:306).

FIG. 224 shows a nucleotide sequence designated herein as DNA54389 (SEQ ID NO:307).

FIG. 225 shows a nucleotide sequence (SEQ ID NO:308) of a native sequence PRO1132 (UNQ570) cDNA, wherein SEQ ID NO:308 is a clone designated herein as "DNA59767-1489".

FIG. 226 shows the amino acid sequence (SEQ ID NO:309) derived from the coding sequence of SEQ ID NO:308 shown in FIG. 225.

FIG. 227 shows a nucleotide sequence (SEQ ID NO:313) of a native sequence PRO1346 cDNA, wherein SEQ ID NO:313 is a clone designated herein as "DNA59776-1600".

FIG. 228 shows the amino acid sequence (SEQ ID NO:314) derived from the coding sequence of SEQ ID NO:313 shown in FIG. 227.

FIG. 229 shows a nucleotide sequence (SEQ ID NO:318) of a native sequence PRO1131 (UNQ569) cDNA, wherein SEQ ID NO:318 is a clone designated herein as "DNA59777-1480".

FIG. 230 shows the amino acid sequence (SEQ ID NO:319) derived from the coding sequence of SEQ ID NO:318 shown in FIG. 229.

FIG. 231 shows a nucleotide sequence designated herein as DNA43546 (SEQ ID NO:320).

FIG. 232 shows a nucleotide sequence (SEQ ID NO:325) of a native sequence PRO1281 (UNQ651) cDNA, wherein SEQ ID NO:325 is a clone designated herein as "DNA59820-1549".

FIG. 233 shows the amino acid sequence (SEQ ID NO:326) derived from the coding sequence of SEQ ID NO:325 shown in FIG. 232.

FIG. 234 shows a nucleotide sequence (SEQ ID NO:333) of a native sequence PRO1064 (UNQ111) cDNA, wherein SEQ ID NO:333 is a clone designated herein as "DNA59827-1426".

FIG. 235 shows the amino acid sequence (SEQ ID NO:334) derived from the coding sequence of SEQ ID NO:333 shown in FIG. 234.

FIG. 236 shows a nucleotide sequence designated herein as DNA45288 (SEQ ID NO:335).

FIG. 237 shows a nucleotide sequence (SEQ ID NO:339) of a native sequence PRO1379 (UNQ716) cDNA, wherein SEQ ID NO:339 is a clone designated herein as "DNA59828-1608".

FIG. 238 shows the amino acid sequence (SEQ ID NO:340) derived from the coding sequence of SEQ ID NO:339 shown in FIG. 237.

FIG. 239 shows a nucleotide sequence (SEQ ID NO:344) of a native sequence PRO844 (UNQ544) cDNA, wherein SEQ ID NO:344 is a clone designated herein as "DNA59838-1462".

FIG. 240 shows the amino acid sequence (SEQ ID NO:345) derived from the coding sequence of SEQ ID NO:344 shown in FIG. 239.

FIG. 241 shows a nucleotide sequence (SEQ ID NO:346) of a native sequence PRO848 (UNQ543) cDNA, wherein SEQ ID NO:346 is a clone designated herein as "DNA59839-1461".

FIG. 242 shows the amino acid sequence (SEQ ID NO:347) derived from the coding sequence of SEQ ID NO:346 shown in FIG. 241.

FIG. 243 shows a nucleotide sequence (SEQ ID NO:348) of a native sequence PRO1097 (UNQ542) cDNA, wherein SEQ ID NO:348 is a clone designated herein as "DNA59841-1460".

FIG. 244 shows the amino acid sequence (SEQ ID NO:349) derived from the coding sequence of SEQ ID NO:348 shown in FIG. 243.

FIG. 245 shows a nucleotide sequence (SEQ ID NO:350) of a native sequence PRO1153 (UNQ583) cDNA, wherein SEQ ID NO:350 is a clone designated herein as "DNA59842-1502".

FIG. 246 shows the amino acid sequence (SEQ ID NO:351) derived from the coding sequence of SEQ ID NO:350 shown in FIG. 245.

FIG. 247 shows a nucleotide sequence (SEQ ID NO:352) of a native sequence PRO1154 (UNQ584) cDNA, wherein SEQ ID NO:352 is a clone designated herein as "DNA59846-1503".

FIG. 248 shows the amino acid sequence (SEQ ID NO:353) derived from the coding sequence of SEQ ID NO:352 shown in FIG. 247.

FIG. 249 shows a nucleotide sequence (SEQ ID NO:354) of a native sequence PRO1181 (UNQ595) cDNA, wherein SEQ ID NO:354 is a clone designated herein as "DNA59847-1511".

FIG. 250 shows the amino acid sequence (SEQ ID NO:355) derived from the coding sequence of SEQ ID NO:354 shown in FIG. 249.

FIG. 251 shows a nucleotide sequence (SEQ ID NO:356) of a native sequence PRO1182 (UNQ596) cDNA, wherein SEQ ID NO:356 is a clone designated herein as "DNA59848-1512".

FIG. 252 shows the amino acid sequence (SEQ ID NO:357) derived from the coding sequence of SEQ ID NO:356 shown in FIG. 251.

FIG. 253 shows a nucleotide sequence (SEQ ID NO:358) of a native sequence PRO1155 (UNQ585) cDNA, wherein SEQ ID NO:358 is a clone designated herein as "DNA59849-1504".

FIG. 254 shows the amino acid sequence (SEQ ID NO:359) derived from the coding sequence of SEQ ID NO:358 shown in FIG. 253.

FIG. 255 shows a nucleotide sequence (SEQ ID NO:360) of a native sequence PRO1156 (UNQ586) cDNA, wherein SEQ ID NO:360 is a clone designated herein as "DNA59853-1505".

FIG. 256 shows the amino acid sequence (SEQ ID NO:361) derived from the coding sequence of SEQ ID NO:360 shown in FIG. 255.

FIG. 257 shows a nucleotide sequence (SEQ ID NO:362) of a native sequence PRO1098 (UNQ541) cDNA, wherein SEQ ID NO:362 is a clone designated herein as "DNA59854-1459".

FIG. 258 shows the amino acid sequence (SEQ ID NO:363) derived from the coding sequence of SEQ ID NO:362 shown in FIG. 257.

FIG. 259 shows a nucleotide sequence (SEQ ID NO:364) of a native sequence PRO1127 (UNQ565) cDNA, wherein SEQ ID NO:364 is a clone designated herein as "DNA60283-1484".

FIG. 260 shows the amino acid sequence (SEQ ID NO:365) derived from the coding sequence of SEQ ID NO:364 shown in FIG. 259.

FIG. 261 shows a nucleotide sequence (SEQ ID NO:366) of a native sequence PRO1126 (UNQ564) cDNA, wherein SEQ ID NO:366 is a clone designated herein as "DNA60615-1483".

FIG. 262 shows the amino acid sequence (SEQ ID NO:367) derived from the coding sequence of SEQ ID NO:366 shown in FIG. 261.

FIG. 263 shows a nucleotide sequence (SEQ ID NO:368) of a native sequence PRO1125 (UNQ563) cDNA, wherein SEQ ID NO:368 is a clone designated herein as "DNA60619-1482".

FIG. 264 shows the amino acid sequence (SEQ ID NO:369) derived from the coding sequence of SEQ ID NO:368 shown in FIG. 263.

FIG. 265 shows a nucleotide sequence (SEQ ID NO:370) of a native sequence PRO1186 (UNQ600) cDNA, wherein SEQ ID NO:370 is a clone designated herein as "DNA60621-1516".

FIG. 266 shows the amino acid sequence (SEQ ID NO:371) derived from the coding sequence of SEQ ID NO:370 shown in FIG. 265.

FIG. 267 shows a nucleotide sequence (SEQ ID NO:372) of a native sequence PRO1198 (UNQ611) cDNA, wherein SEQ ID NO:372 is a clone designated herein as "DNA60622-1525 ".

FIG. 268 shows the amino acid sequence (SEQ ID NO:373) derived from the coding sequence of SEQ ID NO:372 shown in FIG. 267.

FIG. 269 shows a nucleotide sequence (SEQ ID NO:374) of a native sequence PRO1158 (UNQ588) cDNA, wherein SEQ ID NO:374 is a clone designated herein as "DNA60625-1507".

FIG. 270 shows the amino acid sequence (SEQ ID NO:375) derived from the coding sequence of SEQ ID NO:374 shown in FIG. 269.

FIG. 271 shows a nucleotide sequence (SEQ ID NO:376) of a native sequence PRO1159 (UNQ589) cDNA, wherein SEQ ID NO:376 is a clone designated herein as "DNA60627-1508".

FIG. 272 shows the amino acid sequence (SEQ ID NO:377) derived from the coding sequence of SEQ ID NO:376 shown in FIG. 271.

FIG. 273 shows a nucleotide sequence (SEQ ID NO:378) of a native sequence PRO1124 (UNQ562) cDNA, wherein SEQ ID NO:378 is a clone designated herein as "DNA60629-1481".

FIG. 274 shows the amino acid sequence (SEQ ID NO:379) derived from the coding sequence of SEQ ID NO:378 shown in FIG. 273.

FIG. 275 shows a nucleotide sequence (SEQ ID NO:380) of a native sequence PRO1287 (UNQ656) cDNA, wherein SEQ ID NO:380 is a clone designated herein as "DNA61755-1554".

FIG. 276 shows the amino acid sequence (SEQ ID NO:381) derived from the coding sequence of SEQ ID NO:380 shown in FIG. 275.

FIG. 277 shows a nucleotide sequence (SEQ ID NO:386) of a native sequence PRO1312 (UNQ678) cDNA, wherein SEQ ID NO:386 is a clone designated herein as "DNA61873-1574".

FIG. 278 shows the amino acid sequence (SEQ ID NO:387) derived from the coding sequence of SEQ ID NO:386 shown in FIG. 277.

FIG. 279 shows a nucleotide sequence (SEQ ID NO:388) of a native sequence PRO1192 (UNQ606) cDNA, wherein SEQ ID NO:388 is a clone designated herein as "DNA62814-1521".

FIG. 280 shows the amino acid sequence (SEQ ID NO:389) derived from the coding sequence of SEQ ID NO:388 shown in FIG. 279.

FIG. 281 shows a nucleotide sequence (SEQ ID NO:393) of a native sequence PRO1160 (UNQ590) cDNA, wherein SEQ ID NO:393 is a clone designated herein as "DNA62872-1509".

FIG. 282 shows the amino acid sequence (SEQ ID NO:394) derived from the coding sequence of SEQ ID NO:393 shown in FIG. 281.

FIG. 283 shows a nucleotide sequence (SEQ ID NO:398) of a native sequence PRO1187 (UNQ601) cDNA, wherein SEQ ID NO:398 is a clone designated herein as "DNA62876-1517".

FIG. 284 shows the amino acid sequence (SEQ ID NO:399) derived from the coding sequence of SEQ ID NO:398 shown in FIG. 283.

FIG. 285 shows a nucleotide sequence (SEQ ID NO:400) of a native sequence PRO1185 (UNQ599) cDNA, wherein SEQ ID NO:400 is a clone designated herein as "DNA62881-1515".

FIG. 286 shows the amino acid sequence (SEQ ID NO:401) derived from the coding sequence of SEQ ID NO:400 shown in FIG. 285.

FIG. 287 shows a nucleotide sequence (SEQ ID NO:402) of a native sequence PRO1345 (UNQ700) cDNA, wherein SEQ ID NO:402 is a clone designated herein as "DNA64852-1589".

FIG. 288 shows the amino acid sequence (SEQ ID NO:403) derived from the coding sequence of SEQ ID NO:402 shown in FIG. 287.

FIG. 289 shows a nucleotide sequence (SEQ ID NO:407) of a native sequence PRO1245 (UNQ629) cDNA, wherein SEQ ID NO:407 is a clone designated herein as "DNA64884-1527".

FIG. 290 shows the amino acid sequence (SEQ ID NO:408) derived from the coding sequence of SEQ ID NO:407 shown in FIG. 289.

FIG. 291 shows a nucleotide sequence (SEQ ID NO:409) of a native sequence PRO1358 (UNQ707) cDNA, wherein SEQ ID NO:409 is a clone designated herein as "DNA64890-1612".

FIG. 292 shows the amino acid sequence (SEQ ID NO:410) derived from the coding sequence of SEQ ID NO:409 shown in FIG. 291.

FIG. 293 shows a nucleotide sequence (SEQ ID NO:411) of a native sequence PRO1195 (UNQ608) cDNA, wherein SEQ ID NO:411 is a clone designated herein as "DNA65412-1523".

FIG. 294 shows the amino acid sequence (SEQ ID NO:412) derived from the coding sequence of SEQ ID 140:411 shown in FIG. 293.

FIG. 295 shows a nucleotide sequence (SEQ ID NO:413) of a native sequence PRO1270 (UNQ640) cDNA, wherein SEQ ID NO:413 is a clone designated herein as "DNA66308-1537".

FIG. 296 shows the amino acid sequence (SEQ ID NO:414) derived from the coding sequence of SEQ ID NO:413 shown in FIG. 295.

FIG. 297 shows a nucleotide sequence (SEQ ID NO:415) of a native sequence PRO1271 (UNQ641) cDNA, wherein SEQ ID NO:415 is a clone designated herein as "DNA66309-1538".

FIG. 298 shows the amino acid sequence (SEQ ID NO:416) derived from the coding sequence of SEQ ID NO:415 shown in FIG. 297.

FIG. 299 shows a nucleotide sequence (SEQ ID NO:417) of a native sequence PRO1375 (UNQ712) cDNA, wherein SEQ ID NO:417 is a clone designated herein as "DNA67004-1614".

FIG. 300 shows the amino acid sequence (SEQ ID NO:418) derived from the coding sequence of SEQ ID NO:417 shown in FIG. 299.

FIG. 301 shows a nucleotide sequence (SEQ ID NO:419) of a native sequence PRO1385 (UNQ720) cDNA, wherein SEQ ID NO:419 is a clone designated herein as "DNA68869-1610".

FIG. 302 shows the amino acid sequence (SEQ ID NO:420) derived from the coding sequence of SEQ ID NO:419 shown in FIG. 301.

FIG. 303 shows a nucleotide sequence (SEQ ID NO:421) of a native sequence PRO1387 (UNQ722) cDNA, wherein SEQ ID NO:421 is a clone designated herein as "DNA68872-1620".

FIG. 304 shows the amino acid sequence (SEQ ID NO:422) derived from the coding sequence of SEQ ID NO:421 shown in FIG. 303.

FIG. 305 shows a nucleotide sequence (SEQ ID NO:423) of a native sequence PRO1384 (UNQ721) cDNA, wherein SEQ ID NO:423 is a clone designated herein as "DNA71159-1617".

FIG. 306 shows the amino acid sequence (SEQ ID NO:424) derived from the coding sequence of SEQ ID NO:423 shown in FIG. 305.

FIG. 307 shows a nucleotide sequence (SEQ ID NO:494) of a native sequence PRO183 cDNA, wherein SEQ ID NO:494 is a clone designated herein as "DNA28498".

FIG. 308 shows the amino acid sequence (SEQ ID NO:495) derived from the coding sequence of SEQ ID NO:494 shown in FIG. 307.

FIG. 309 shows a nucleotide sequence (SEQ ID NO:496) of a native sequence PRO184 cDNA, wherein SEQ ID NO:496 is a clone designated herein as "DNA28500."

FIG. 310 shows the amino acid sequence (SEQ ID NO:497) derived from the coding sequence of SEQ ID NO:496 shown in FIG. 309.

FIG. 311 shows a nucleotide sequence (SEQ ID NO:498) of a native sequence PRO185 cDNA, wherein SEQ ID NO:498 is a clone designated herein as "DNA28503".

FIG. 312 shows the amino acid sequence (SEQ ID NO:499) derived from the coding sequence of SEQ ID NO:498 shown in FIG. 311.

FIG. 313 shows a nucleotide sequence (SEQ ID NO:500) of a native sequence PRO331 cDNA, wherein SEQ ID NO:500 is a clone designated herein as "DNA40981-1234".

FIG. 314 shows the amino acid sequence (SEQ ID NO:501) derived from the coding sequence of SEQ ID NO:500 shown in FIG. 313.

FIG. 315 shows a nucleotide sequence (SEQ ID NO:502) of a native sequence PRO363 cDNA, wherein SEQ ID NO:502 is a clone designated herein as "DNA45419-1252".

FIG. 316 shows the amino acid sequence (SEQ ID NO:503) derived from the coding sequence of SEQ ID NO:502 shown in FIG. 315.

FIG. 317 shows a nucleotide sequence (SEQ ID NO:504) of a native sequence PRO5723 cDNA, wherein SEQ ID NO:504 is a clone designated herein as "DNA82361".

FIG. 318 shows the amino acid sequence (SEQ ID NO:505) derived from the coding sequence of SEQ ID NO:504 shown in FIG. 317.

FIG. 319 shows a nucleotide sequence (SEQ ID NO:506) of a native sequence PRO3301 cDNA, wherein SEQ ID NO:506 is a clone designated herein as "DNA88002".

FIG. 320 shows the amino acid sequence (SEQ ID NO:507) derived from the coding sequence of SEQ ID NO:506 shown in FIG. 319.

FIG. 321 shows a nucleotide sequence (SEQ ID NO:508) of a native sequence PRO9940 cDNA, wherein SEQ ID NO:508 is a clone designated herein as "DNA92282".

FIG. 322 shows the amino acid sequence (SEQ ID NO:509) derived from the coding sequence of SEQ ID NO:508 shown in FIG. 321.

FIG. 323 shows a nucleotide sequence (SEQ ID NO:510) of a native sequence PRO9828 cDNA, wherein SEQ ID NO:510 is a clone designated herein as "DNA142238-2768".

FIG. 324 shows the amino acid sequence (SEQ ID NO:511) derived from the coding sequence of SEQ ID NO:510 shown in FIG. 323.

FIG. 325 shows a nucleotide sequence (SEQ ID NO:512) of a native sequence PRO7170 cDNA, wherein SEQ ID NO:512 is a clone designated herein as "DNA108722-2743".

FIG. 326 shows the amino acid sequence (SEQ ID NO:513) derived from the coding sequence of SEQ ID NO:512 shown in FIG. 325.

FIG. 327 shows a nucleotide sequence (SEQ ID NO:514) of a native sequence PRO361 cDNA, wherein SEQ ID NO:514 is a clone designated herein as "DNA45410-1250".

FIG. 328 shows the amino acid sequence (SEQ ID NO:515) derived from the coding sequence of SEQ ID NO:514 shown in FIG. 327.

FIG. 329 shows a nucleotide sequence (SEQ ID NO:516) of a native sequence PRO846 cDNA, wherein SEQ ID NO:516 is a clone designated herein as "DNA44196-1353".

FIG. 330 shows the amino acid sequence (SEQ ID NO:517) derived from the coding sequence of SEQ ID NO:516 shown in FIG. 329.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1–6 (1997) and von Heinje et al., *Nucl. Acids. Res.* 14:4683–4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention. "PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, preferably at least about 81% amino acid sequence identity, more preferably at least about 82% amino acid sequence identity, more preferably at least about 83% amino acid sequence identity, more preferably at least about 84% amino acid sequence identity, more preferably at least about 85% amino acid sequence identity, more preferably at least about 86% amino acid sequence identity, more preferably at least about 87% amino acid sequence identity, more preferably at least about 88% amino acid sequence identity, more preferably at least about 89% amino acid sequence identity, more preferably at least about 90% amino acid sequence identity, more preferably at least about 91% amino acid sequence identity, more preferably at least about 92% amino acid sequence identity, more preferably at least about 93% amino acid sequence identity, more preferably at least about 94% amino acid sequence identity, more preferably at least about 95% amino acid sequence identity, more preferably at least about 96% amino acid sequence identity, more preferably at least about 97% amino acid sequence identity, more preferably at least about 98% amino acid sequence identity and most preferably at least about 99% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, often at least about 20 amino acids in length, more often at least about 30 amino acids in length, more often at least about 40 amino acids in length, more often at least about 50 amino acids in length, more often at least about 60 amino acids in length, more often at least about 70 amino acids in length, more often at least about 80 amino acids in length, more often at least about 90 amino acids in length, more often at least about 100 amino acids in length, more often at least about 150 amino acids in length, more often at least about 200 amino acids in length, more often at least about 300 amino acids in length, or more. "Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X, "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res.* 25:3389–3402 (1997)). NCBI-BLAST2 uses several search parameters, wherein all of those search parameters are set to default values including, for example, unmask=yes, strand=all, expected occurrences=10, minimum low complexity length=1515, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction $X/Y$ where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, more preferably at least about 81% nucleic acid sequence identity, more preferably at least about 82% nucleic acid sequence identity, more preferably at least about 83% nucleic acid sequence identity, more preferably at least about 84% nucleic acid sequence identity, more preferably at least about 85% nucleic acid sequence identity, more preferably at least about 86% nucleic acid sequence identity, more preferably at least about 87% nucleic acid sequence identity, more preferably at least about 88% nucleic acid sequence identity, more preferably at least about 89% nucleic acid sequence identity, more preferably at least about 90% nucleic acid sequence identity, more preferably at least about 91% nucleic acid sequence identity, more preferably at least about 92% nucleic acid sequence identity, more preferably at least about 93% nucleic acid sequence identity, more preferably at least about 94% nucleic acid sequence identity, more preferably at least about 95% nucleic acid sequence identity, more preferably at least about 96% nucleic acid sequence identity, more preferably at least about 97% nucleic acid sequence identity, more preferably at least about 98% nucleic acid sequence identity and yet more preferably at least about 99% nucleic acid sequence identity wit h a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, often at least about 60 nucleotides in length, more often at least about 90 nucleotides in length, more often at least about 120 nucleotides in length, more often at least about 150 nucleotides in length, more often at least about 180 nucleotides in length, more often at least about 210 nucleotides in length, more often at least about 240 nucleotides in length, more often at least about 270 nucleotides in length, more often at least about 300 nucleotides in length, more often at least about 450 nucleotides in length, more often at least about 600 nucleotides in length, more often at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction $W/Z$ where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N, "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., *Nucleic Acids Res.* 25:3389–3402 (1997)). NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction $W/Z$ where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

The term "positives", in the context of sequence comparison performed as described above, includes residues in the sequences compared that are not identical but have similar properties (e.g. as a result of conservative substitutions, see Table 6 below). For purposes herein, the % value of positives is determined by dividing (a) the number of amino acid residues scoring a positive value between the PRO polypeptide amino acid sequence of interest having a sequence derived from the native PRO polypeptide sequence and the comparison amino acid sequence of interest (i.e., the amino acid sequence against which the PRO polypeptide sequence is being compared) as determined in the BLOSUM62 matrix of WU-BLAST-2 by (b) the total number of amino acid residues of the PRO polypeptide of interest.

Unless specifically stated otherwise, the % value of positives is calculated as described in the immediately preceding paragraph. However, in the context of the amino acid sequence identity comparisons performed as described for ALIGN-2 and NCBI-BLAST-2 above, includes amino acid residues in the sequences compared that are not only identical, but also those that have similar properties. Amino acid residues that score a positive value to an amino acid residue of interest are those that are either identical to the amino acid residue of interest or are a preferred substitution (as defined in Table 6 below) of the amino acid residue of interest.

For amino acid sequence comparisons using ALIGN-2 or NCBI-BLAST2, the % value of positives of a given amino acid sequence A to, with, or against a given amino acid sequence B (which can alternatively be phrased as a given amino acid sequence A that has or comprises a certain % positives to, with, or against a given amino acid sequence B) is calculated as follows:

100 times the fraction $X/Y$ where X is the number of amino acid residues scoring a positive value as defined above by the sequence alignment program ALIGN-2 or NCBI-BLAST2 in that program's alignment of A and B, and where Y is the total number of amino acid residues in B. It will be appreciated that where the length of amino acid sequence A is not equal to the length of amino acid sequence B, the % positives of A to B will not equal the % positives of B to A.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts. "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and %SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., *Protein Eng.* 8(10):1057–1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH 1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269–315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444–6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

TABLE 1

```
/*
*
* C—C increased from 12 to 15
* Z is average of EQ
* B is average of ND
* match with stop is _M; stop—stop = 0; J (joker) match = 0
*/
#define _M  -8  /* value of a match with a stop */
int     _day[26][26] = {
/*      A B C D E F G H I J K L M N O P Q R S T U V W X Y Z */
/* A */ { 2, 0,-2, 0, 0,-4, 1,-1,-1, 0,-1,-2,-1, 0,_M, 1, 0,-2, 1, 1, 0, 0,-6, 0,-3, 0},
/* B */ { 0, 3,-4, 3, 2,-5, 0, 1,-2, 0, 0,-3,-2, 2,_M,-1, 1, 0, 0, 0, 0,-2,-5, 0,-3, 1},
/* C */ {-2,-4,15,-5,-5,-4,-3,-3,-2, 0,-5,-6,-5,-4,_M,-3,-5,-4, 0,-2, 0,-2,-8, 0, 0,-5},
/* D */ { 0, 3,-5, 4, 3,-6, 1, 1,-2, 0, 0,-4,-3, 2,_M,-1, 2,-1, 0, 0, 0,-2,-7, 0,-4, 2},
/* E */ { 0, 2,-5, 3, 4,-5, 0, 1,-2, 0, 0,-3,-2, 1,_M,-1, 2,-1, 0, 0, 0,-2,-7, 0,-4, 3},
/* F */ {-4,-5,-4,-6,-5, 9,-5,-2, 1, 0,-5, 2, 0,-4,_M,-5,-5,-4,-3,-3, 0,-1, 0, 0, 7,-5},
/* G */ { 1, 0,-3, 1, 0,-5, 5,-2,-3, 0,-2,-4,-3, 0,_M,-1,-1,-3, 1, 0, 0,-1,-7, 0,-5, 0},
/* H */ {-1, 1,-3, 1, 1,-2,-2, 6,-2, 0, 0,-2,-2, 2,_M, 0, 3, 2,-1,-1, 0,-2,-3, 0, 0, 2},
/* I */ {-1,-2,-2,-2,-2, 1,-3,-2, 5, 0,-2, 2, 2,-2,_M,-2,-2,-2,-1, 0, 0, 4,-5, 0,-1,-2},
/* J */ { 0, 0, 0, 0, 0, 0, 0, 0, 0, 0, 0, 0, 0, 0,_M, 0, 0, 0, 0, 0, 0, 0, 0, 0, 0, 0},
/* K */ {-1, 0,-5, 0, 0,-5,-2, 0,-2, 0, 5,-3, 0, 1,_M,-1, 1, 3, 0, 0, 0,-2,-3, 0,-4, 0},
/* L */ {-2,-3,-6,-4,-3, 2,-4,-2, 2, 0,-3, 6, 4,-3,_M,-3,-2,-3,-3,-1, 0, 2,-2, 0,-1,-2},
/* M */ {-1,-2,-5,-3,-2, 0,-3,-2, 2, 0, 0, 4, 6,-2,_M,-2,-1, 0,-2,-1, 0, 2,-4, 0,-2,-1},
/* N */ { 0, 2,-4, 2, 1,-4, 0, 2,-2, 0, 1,-3,-2, 2,_M,-1, 1, 0, 1, 0, 0,-2,-4, 0,-2, 1},
/* O */ {_M,_M,_M,_M,_M,_M,_M,_M,_M,_M,_M,_M,_M,_M,_M, 0,_M,_M,_M,_M,_M,_M,_M,_M,_M,_M,},
/* P */ { 1,-1,-3,-1,-1,-5,-1, 0,-2, 0,-1,-3,-2,-1,_M, 6, 0, 0, 1, 0, 0,-1,-6, 0,-5, 0},
/* Q */ { 0, 1,-5, 2, 2,-5,-1, 3,-2, 0, 1,-2,-1, 1,_M, 0, 4, 1,-1,-1, 0,-2,-5, 0,-4, 3},
/* R */ {-2, 0,-4,-1,-1,-4,-3, 2,-2, 0, 3,-3, 0, 0,_M, 0, 1, 6, 0,-1, 0,-2, 2, 0,-4, 0},
/* S */ { 1, 0, 0, 0, 0,-3, 1,-1,-1, 0, 0,-3,-2, 1,_M, 1,-1, 0, 2, 1, 0,-1,-2, 0,-3, 0},
/* T */ { 1, 0,-2, 0, 0,-3, 0,-1, 0, 0, 0,-1,-1, 0,_M, 0,-1,-1, 1, 3, 0, 0,-5, 0,-3, 0},
/* U */ { 0, 0, 0, 0, 0, 0, 0, 0, 0, 0, 0, 0, 0, 0,_M, 0, 0, 0, 0, 0, 0, 0, 0, 0, 0, 0},
/* V */ { 0,-2,-2,-2,-2,-1,-1,-2, 4, 0,-2, 2, 2,-2,_M,-1,-2,-2,-1, 0, 0, 4,-6, 0,-2,-2},
/* W */ {-6,-5,-8,-7,-7, 0,-7,-3,-5, 0,-3,-2,-4,-4,_M,-6,-5, 2,-2,-5, 0,-6,17, 0, 0,-6},
/* X */ { 0, 0, 0, 0, 0, 0, 0, 0, 0, 0, 0, 0, 0, 0,_M, 0, 0, 0, 0, 0, 0, 0, 0, 0, 0, 0},
/* Y */ {-3,-3, 0,-4,-4, 7,-5, 0,-1, 0,-4,-1,-2,-2,_M,-5,-4,-4,-3,-3, 0,-2, 0, 0,10,-4},
/* Z */ { 0, 1,-5, 2, 3,-5, 0, 2,-2, 0, 0,-2,-1, 1,_M, 0, 3, 0, 0, 0, 0,-2,-6, 0,-4, 4}
};
/*
*/
#include   <stdio.h>
#include   <ctype.h>
#define    MAXJMP    16      /* max jumps in a diag */
#define    MAXGAP    24      /* don't continue to penalize gaps larger than this */
#define    JMPS      1024    /* max jmps in an path */
#define    MX        4       /* save if there's at least MX-1 bases since last jmp */
#define    DMAT      3       /* value of matching bases */
#define    DMIS      0       /* penalty for mismatched bases */
#define    DINS0     8       /* penalty for a gap */
#define    DINS1     1       /* penalty per base */
#define    PINS0     8       /* penalty for a gap */
#define    PINS1     4       /* penalty per residue */
struct jmp {
           short          n[MAXJMP];     /* size of jmp (neg for dely) */
           unsigned short x[MAXJMP];     /* base no. of jmp in seq x */
```

TABLE 1-continued

```
};                              /* limits seq to 2^16 -1 */
struct diag {
        int         score;       /* score at last jmp */
        long        offset;      /* offset of prev block */
        short       ijmp;        /* current jmp index */
        struct jmp  jp;          /* list of jmps */
};
struct path {
        int         spc;         /* number of leading spaces */
        short       n[JMPS];     /* size of jmp (gap) */
        int         x[JMPS];     /* loc of jmp (last elem before gap) */
};
char            *ofile;          /* output file name */
char            *namex[2];       /* seq names: getseqs() */
char            *prog;           /* prog name for err msgs */
char            *seqx[2];            /* seqs: getseqs() */
int             dmax;            /* best diag: nw() */
int             dmax0;           /* final diag */
int             dna;             /* set if dna: main() */
int             endgaps;         /* set if penalizing end gaps */
int             gapx, gapy;      /* total gaps in seqs */
int             len0, len1;      /* seq lens */
int             ngapx, ngapy;    /* total size of gaps */
int             smax;            /* max score: nw() */
int             *xbm;            /* bitmap for matching */
long            offset;          /* current offset in jmp file */
struct  diag    *dx;             /* holds diagonals */
struct  path    pp[2];           /* holds path for seqs */
char            *calloc(), *malloc(), *index(), *strcpy();
char            *getseq(), *g_calloc();
/* Needleman-Wunsch alignment program
*
* usage: progs file1 file2
*   where file1 and file2 are two dna or two protein sequences.
*   The sequences can be in upper- or lower-case an may contain ambiguity
*   Any lines beginning with ';', '>' or '<' are ignored
*   Max file length is 65535 (limited by unsigned short x in the jmp struct)
*   A sequence with 1/3 or more of its elements ACGTU is assumed to be DNA
*   Output is in the file "align.out"
*
* The program may create a tmp file in /tmp to hold info about traceback.
* Original version developed under BSD 4.3 on a vax 8650
*/
#include "nw.h"
#include "day.h"
static   _dbval[26] = {
         1,14,2,13,0,0,4,11,0,0,12,0,3,15,0,0,0,5,6,8,8,7,9,9,0,10,0
};
static   _pbval[26] = {
         1, 2 | (1 < <('D'-'A')) | (1 < <('N'-'A')), 4, 8, 16, 32, 64,
         128, 256, 0xFFFFFFFF, 1 < <10, 1 < <11, 1 < <12, 1 < <13, 1 < <14,
         1 < <15, 1 < <16, 1 < <17, 1 < <18, 1 < <19, 1 < <20, 1 < <21, 1 < <22,
         1 < <23, 1 < <24, 1 < <25, | (1 < <('E'-'A')) | (1 < <('Q'-'A'))
};
main(ac, av)                                                                                    main
        int     ac;
        char    *av[];
{
        prog = av[0];
        if (ac != 3) {
                fprintf(stderr,"usage: %s file1 file2\n", prog);
                fprintf(stderr,"where file1 and file2 are two dna or two protein sequences.\n");
                fprintf(stderr,"The sequences can be in upper- or lower-case\n");
                fprintf(stderr,"Any lines beginning with ';' or '<' are ignored\n");
                fprintf(stderr,"Output is in the file \"align.out\"\n");
                exit(1);
        }
        namex[0] = av[1];
        namex[1] = av[2];
        seqx[0] = getseq(namex[0], &len0);
        seqx[1] = getseq(namex[1], &len1);
        xbm = (dna)? _dbval : _pbval;
        endgaps = 0;              /* 1 to penalize endgaps */
        ofile = "align.out";      /* output file */
        nw();                     /* fill in the matrix, get the possible jmps */
        readjmps();               /* get the actual jmps */
        print();                  /* print stats, alignment */
        cleanup(0);               /* unlink any tmp files */
}
```

TABLE 1-continued

```
/* do the alignment, return best score: main()
* dna: values in Fitch and Smith, PNAS, 80, 1382-1386, 1983
* pro: PAM 250 values
* When scores are equal, we prefer mismatches to any gap, prefer
* a new gap to extending an ongoing gap, and prefer a gap in seqx
* to a gap in seq y.
*/
nw()
{
        char            *px, *py;           /* seqs and ptrs */
        int             *ndely, *dely;      /* keep track of dely */
        int             ndelx, delx;        /* keep track of delx */
        int             *tmp;               /* for swapping row0, row1 */
        int             mis;                /* score for each type */
        int             ins0, ins1;         /* insertion penalties */
        register        id;                 /* diagonal index */
        register        ij;                 /* jmp index */
        register        *col0, *col1;       /* score for curr, last row */
        register        xx, yy;             /* index into seqs */
        dx = (struct diag *)g_calloc("to get diags", len0 + len1 + 1, sizeof(struct diag));
        ndely = (int *)g_calloc("to get ndely", len1 + 1, sizeof(int));
        dely = (int *)g_calloc("to get dely", len1 + 1, sizeof(int));
        col0 = (int *)g_calloc("to get col0", len1 + 1, sizeof(int));
        col1 = (int *)g_calloc("to get col1", len1 + 1, sizeof(int));
        ins0 = (dna)? DINS0 : PINS0;
        ins1 = (dna)? DINS1 : PINS1;
        smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;   /* Waterman Bull Math Biol 84 */
        }
        else
                for (yy = 1; yy <= len1; yy++)
                        dely[yy] = -ins0;
        /* fill in match matrix
        */
        for(px = seqx[0], xx = 1; xx <= len0; px++, xx++) {
                        /* initialize first entry in col
                        */
                        if (endgaps) {
                            if (xx == 1)
                                    col1[0] = delx = -(ins0+ins1);
                            else
                                    col1[0] = delx = col0[0] - ins1;
                            ndelx = xx;
                        }
                        else {
                            col1[0] = 0;
                            delx = -ins0;
                            ndelx = 0;
                        }
for(py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];
        /* update penalty for del in x seq;
        * favor new del over ongong del
        * ignore MAXGAP if weighting endgaps
        */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
```

TABLE 1-continued

```
        }
        /* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }
        /* pick the maximum score; we're favoring
         * mis over any del and delx over dely
         */
                                                                                                ...nw
                        id = xx - yy + len1 - 1;
                        if (mis >= delx && mis >= dely[yy])
                                col1[yy] = mis;
                        else if (delx >= dely[yy]) {
                                col1[yy] = delx;
                                ij = dx[id].ijmp;
                                if (dx[id].jp.n[0] && (!dna || (ndelx >= MAXJMP
                                        && xx > dx[id].jp.x[ij]+MX) || mis > dx[id].score+DINS0)) {
                                        dx[id].ijmp++;
                                        if (++ij >= MAXJMP) {
                                                writejmps(id);
                                                ij = dx[id].ijmp = 0;
                                                dx[id].offset = offset;
                                                offset += sizeof(struct jmp) + sizeof(offset);
                                        }
                                }
                                dx[id].jp.n[ij] = ndelx;
                                dx[id].jp.x[ij] = xx;
                                dx[id].score = delx;
                        }
                        else {
                                col1[yy] = dely[yy];
                                ij = dx[id].ijmp;
if (dx[id].jp.n[0] && (!dna || (ndely[yy] >= MAXJMP
                                        && xx > dx[id].jp.x[ij]+MX) || mis > dx[id].score+DINS0)) {
                                        dx[id].ijmp++;
                                        if (++ij >= MAXJMP) {
                                                writejmps(id);
                                                ij = dx[id].ijmp = 0;
                                                dx[id].offset = offset;
                                                offset += sizeof(struct jmp) + sizeof(offset);
                                        }
                                }
                                dx[id].jp.n[ij] = -ndely[yy];
                                dx[id].jp.x[ij] = xx;
                                dx[id].score = dely[yy];
                        }
                        if (xx == len0 && yy < len1) {
                                /* last col
                                 */
                                if (endgaps)
                                        col1[yy] -= ins0+ins1*(len1-yy);
                                if (col1[yy] > smax) {
                                        smax = col1[yy];
                                        dmax = id;
                                }
                        }
                }
                if (endgaps && xx < len0)
                        col1[yy-1] -= ins0+ins1*(len0-xx);
                if (col1[yy-1] > smax) {
                        smax = col1[yy-1];
                        dmax = id;
                }
        }
        tmp = col0; col0 = col1; col1 = tmp;
}
```

TABLE 1-continued

```
                (void) free((char *)ndely);
                (void) free((char *)dely);
                (void) free((char *)col0);
                (void) free((char *)col1);
}
/*
*
* print() -- only routine visible outside this module
*
* static:
* getmat() -- trace back best path, count matches: print()
* pr_align() -- print alignment of described in array p[ ]: print()
* dumpblock() -- dump a block of lines with numbers, stars: pr_align()
* nums() -- put out a number line: dumpblock()
* putline() -- put out a line (name, [num], seq, [num]): dumpblock()
* stars() --put a line of stars: dumpblock()
* stripname() -- strip any path and prefix from a seqname
*/
#include "nw.h"
#define SPC         3
#define P_LINE      256     /* maximum output line */
#define P_SPC       3       /* space between name or num and seq */
extern      _day[26][26];
int         olen;                   /* set output line length */
FILE        *fx;                    /* output file */
print()                                                                         print
{
        int     lx, ly, firstgap, lastgap;  /* overlap */
        if ((fx = fopen(ofile, "w")) == 0) {
                fprintf(stderr,"%s: can't write %s\n". prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align();
}
/*
* trace back the best path, count matches
*/
static
getmat(lx, ly, firstgap, lastgap)                                               getmat
        int     lx, ly;                     /* "core" (minus endgaps) */
        int     firstgap, lastgap;          /* leading trailing overlap */
{
        int             nm, i0, i1, siz0, siz1;
        char            outx[32];
        double          pct;
        register        n0, n1;
        register char   *p0, *p1;
        /* get total matches, score
        */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;
        nm = 0;
        while ( *p0 && *p1 ) {
```

TABLE 1-continued

```
                    if (siz0) {
                              p1++;
                              n1++;
                              siz0--;
                    }
                    else if (siz1) {
                              p0++;
                              n0++;
                              siz1--;
                    }
                    else {
                              if (xbm[*p0-'A']&xbm[*p1-'A'])
                                        nm++;
                              if (n0++ == pp[0].x[i0])
                                        siz0 = pp[0].n[i0++];
                              if (n1++ == pp[1].x[i1])
                                        siz1 = pp[1].n[i1++];
                              p0++;
                              p1++;
                    }
          }
          /* pct homology:
          * if penalizing endgaps, base is the shorter seq
          * else, knock off overhangs and take shorter core
          */
          if (endgaps)
                    lx = (len0 < len1)? len0 : len1;
          else
                    lx = (lx < ly)? lx: ly;
          pct = 100.*(double)nm/(double)lx;
          fprintf(fx, "\n");
          fprintf(fx, "<%d match %s in an overlap of %d: %.2f percent similarity\n",
                    nm, (nm == 1)? "" : "es", lx, pct);
          fprintf(fx, "<gaps in first sequence: %d", gapx);                                            ...getmat
          if (gapx) {
                    (void) sprintf(outx, " (%d %s%s)",
                              ngapx, (dna)? "base":"residue", (ngapx == 1)? "":"s");
                    fprintf(fx,"%s", outx);
          }
          fprintf(fx, ", gaps in second sequence: %d", gapy);
          if (gapy) {
                    (void) sprintf(outx, " (%d %s%s)",
                              ngapy, (dna)? "base":"residue", (ngapy == 1)? "":"s");
                    fprintf(fx,"%s", outx);
          }
          if (dna)
                    fprint(fx,
                    "\n<score: %d (match = %d, mismatch = %d, gap penalty = %d + %d per base)\n",
                    smax, DMAT, DMIS, DINS0, DINS1);
          else
                    fprintf(fx,
                    "\n<score: %d (Dayhoff PAM 250 matrix, gap penalty = %d + %d per residue)\n",
                    smax, PINS0, PINS1);
          if (endgaps)
                    fprintf(fx,
                    "<endgaps penalized, left endgap: %d %s%s, right endgap: %d %s%s\n",
                    firstgap, (dna)? "base" : "residue", (firstgap == 1)? "" : "s",
                    lastgap, (dna)? "base" : "residue", (lastgap == 1)? "" : "s");
          else
                    fprintf(fx, "<endgaps not penalized\n");
}
static          nm;                /* matches in core -- for checking */
static          lmax;              /* lengths of stripped file names */
static          ij[2];             /* jmp index for a path */
static          nc[2];             /* number at start of current line */
static          ni[2];             /* current elem number -- for gapping */
static          siz[2];
static char     *ps[2];            /* ptr to current element */
static char     *po[2];            /* ptr to next output char slot */
static char     out[2][P_LINE];    /* output line */
static char     star[P_LINE];      /* set by stars() */
/*
* print alignment of described in struct path pp[]
*/
static
pr_align()                                                                                             pr_align
{
          int       nn;            /* char count */
          int       more;
          register  i;
```

TABLE 1-continued

```
            for (i = 0, lmax = 0; i < 2; i++) {
                    nn = stripname(namex[i]);
                    if (nn > lmax)
                            lmax = nn;
                    nc[i] = 1;
                    ni[i] = 1;
                    siz[i] = ij[i] = 0;
                    ps[i] = seqx[i];
                    po[i] = out[i];
            }
            for (nn = nm = 0, more = 1; more;) {                                                    ...pr_align
                    for (i = more = 0; i < 2; i++) {
                            /*
                             * do we have more of this sequence?
                             */
                            if (!*ps[i])
                                    continue;
                            more++;
                            if (pp[i].spc) {        /* leading space */
                                    *po[i]++ = ' ';
                                    pp[i].spc--;
                            }
                            else if (siz[i]) {      /* in a gap */
                                    *po[i]++ = '-';
                                    siz[i]--;
                            }
                            else {                  /* we're putting a seq element
                                                     */
                                    *po[i] = *ps[i];
                                    if (islower(*ps[i]))
                                            *ps[i] = toupper(*ps[i]);
                                    po[i]++;
                                    ps[i]++;
                                    /*
                                     * are we at next gap for this seq?
                                     */
                                    if (ni[i] == pp[i].x[ij[i]]) {
                                            /*
                                             * we need to merge all gaps
                                             * at this location
                                             */
                                            siz[i] = pp[i].n[ij[i]++];
                                            while (ni[i] == pp[i].x[ij[i]])
                                                    siz[i] += pp[i].n[ij[i]++];
                                    }
                                    ni[i]++;
                            }
                    }
                    if (++nn == olen || !more && nn) {
                            dumpblock();
                            for (i = 0; i < 2; i++)
                                    po[i] = out[i];
                            nn = 0;
                    }
            }
    }
    /*
     * dump a block of lines, including numbers, stars: pr_align()
     */
    static
    dumpblock()                                                                                     dumpblock
    {
            register i;
            for (i = 0; i < 2; i++)
                    *po[i]-- = '\0';
                                                                                                    ...dumpblock
            (void) putc('\n', fx);
            for (i = 0; i < 2; i++) {
                    if (*out[i] && (*out[i] != ' ' || *(po[i]) != ' ')) {
                            if (i == 0)
                                    nums(i);
                            if (i == 0 && *out[1])
                                    stars();
                            putline(i);
                            if (i == 0 && *out[1])
                                    fprintf(fx, star);
                            if (i == 1)
                                    nums(i);
                    }
```

TABLE 1-continued

```
                }
        }
/*
 * put out a number line: dumpblock()
 */
static
nums(ix)                                                                                                        nums
        int             ix;             /* index in out[] holding seq line */
{
        char                    nline[P_LINE];
        register                i, j;
        register char           *pn, *px, *py;
        for (pn = nline, i = 0; i < lmax+P_SPC; i++, pn++)
                *pn = '';
        for (i = nc[ix], py = out[ix]; *py; py++, pn++) {
                if (*py == '' || *py == '-')
                        *pn = '';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (1 < 0)
                                        *px = '-';
                        }
                        else
                                *pn = '';
                        i++;
                }
        }
        *pn = '\0';
        nc[ix] = i;
        for (pn = nline; *pn; pn++)
                (void) putc(*pn, fx);
        (void) putc('\n', fx);
}
/*
 * put out a line (name, [num], seq. [num]): dumpblock()
 */
static
putline(ix)                                                                                                     putline
        int             ix;
{
                                                                                                                ...putline
        int                     i;
        register char           *px;
        for (px = namex[ix], i = 0; *p && *px != ':'; px++, i++)
                (void) putc(*px, fx);
        for (; i < lmax+P_SPC; i++)
                (void) putc('', fx);
        /* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}
/*
 * put a line of stars (seqs always in out[0], out[1]): dumpblock()
 */
static
stars()                                                                                                         stars
{
        int                     i;
        register char           *p0, *p1, cx, *px;
        if (!*out[0] || (*out[0] == '' && *(po[0]) == '') ||
            !*out[1] || (*out[1] == '' && *(po[1]) == ''))
                return;
        px = star;
        for (i = lmax+P_SPC; i; i--)
                *px++ = '';
        for (p0 = out[0], p1 = out[1]; *p0 && *p1; p0++, p1++) {
                if (isalpha(*p0) && isalpha(*p1)) {
                        if (xbm[*p0-'A']&xbm[*p1-'A']) {
                                cx = '*';
                                nm++;
                        }
                        else if (!dna && _day[*p0-'A'][*p1-'A'] > 0)
```

TABLE 1-continued

```
                                                    cx = '.';
                            else
                                                    cx = '';
                    }
                    else
                                            cx = '';
                    *px++ = cx;
            }
            *px++ = '\n';
            *px = '\0';
    }
    /*
     * strip path or prefix from pn, return len: pr_align()
     */
    static
    stripname(pn)                                                                                       stripname
            char        *pn;        /* file name (may be path) */
    {
            register char           *px, *py;
            py = 0;
            for (px = pn; *px; px++)
                            if(*px == '/')
                                            py = px + 1;
            if (py)
                            (void) strcpy(pn, py);
            return(strlen(pn));
    }
    /*
     * cleanup() -- cleanup any tmp file
     * getseq() -- read in seq, set dna, len, maxlen
     * g_calloc() -- calloc() with error checkin
     * readjmps() -- get the good jmps, from tmp file if necessary
     * writejmps() -- write a filled array of jmps to a tmp file: nw()
     */
    #include "nw.h"
    #include <sys/file.h>
    char        *jname = "/tmp/homgXXXXXX";             /* tmp file for jmps */
    FILE        *fj;
    int         cleanup();                              /* cleanup tmp file */
    long        lseek();
    /*
     * remove any tmp file if we blow
     */
    cleanup(i)                                                                                          cleanup
            int         i;
    {
            if (fj)
                            (void) unlink(jname);
            exit(i);
    }
    /*
     * read, return ptr to seq, set dna, len, maxlen
     * skip lines starting with ';', '<', or '>'
     * seq in upper or lower case
     */
    char        *
    getseq(file, len)                                                                                   getseq
            char        *file;      /* file name */
            int         *len;       /* seq len */
    {
            char                    line[1024], *pseq;
            register char           *px, *py;
            int                     natgc, tlen;
            FILE                    *fp;
            if ((fp = fopen(file, "r")) == 0) {
                            fprintf(stderr,"%s: can't read %s\n", prog, file);
                            exit(1);
            }
            tlen = natgc = 0;
            while (fgets(line, 1024, fp)) {
                            if (*line == ';' || *line == '<' || *line == '>')
                                            continue;
                            for (px = line; *px != '\n'; px++)
                                            if (isupper(*px) || islower(*px))
                                                            tlen++;
            }
            if ((pseq = malloc((unsigned)(tlen+6))) == 0) {
                            fprintf(stderr,"%s: malloc() failed to get %d bytes for %s\n", prog, tlen+6, file);
                            exit(1);
```

TABLE 1-continued

```
        }
        pseq[0] = pseq[1] = pseq[2] = pseq[3] = '\0';                                                    ...getseq
        py = pseq + 4;
        *len = tlen;
        rewind(fp);
        while (fgets(line, 1024, fp)) {
                if (*line == ';' || *line == '<' || *line == '>')
                        continue;
                for (px = line; *px != '\n'; px++) {
                        if (isupper(*px))
                                *py++ = *px;
                        else if (islower(*px))
                                *py++ = toupper(*px);
                        if (index("ATGCU",*(py-1)))
                                natgc++;
                }
        }
        *py++ = '\0';
        *py = '\0';
        (void) fclose(fp);
        dna = natgc > (tlen/3);
        return(pseq+4);
}
char            *
g_calloc(msg, nx, sz)                                                                                   g_calloc
        char            *msg;           /* program, calling routine */
        int             nx, sz;         /* number and size of elements */
{
        char                    *px, *calloc();
        if ((px = calloc((unsigned)nx, (unsigned)sz)) == 0) {
                if (*msg) {
                        fprintf(stderr, "%s: g_calloc() failed %s (n=%d, sz=%d)\n", prog, msg, nx, sz);
                        exit(1);
                }
        }
        return(px);
}
/*
* get final jmps from dx[] or tmp file, set pp[], reset dmax: main()
*/
readjmps()                                                                                              readjmps
{
        int                     fd = -1;
        int                     siz, i0, i1;
        register i, j, xx;
        if (fj) {
                (void) fclose(fj);
                if ((fd = open(jname, O_RDONLY, 0)) < 0) {
                        fprintf(stderr, "%s: can't open() %s\n", prog, jname);
                        cleanup(1);
                }
        }
        for (i = i0 = i1 = 0, dmax0 = dmax, xx = len0; ; i++) {
                while (1) {
                        for (j = dx[dmax].ijmp; j >= 0 && dx[dmax].jp.x[j] >= xx; j--)
                                ;
                                                                                                        ...readjmps
                        if (j < 0 && dx[dmax].offset && fj) {
                                (void) lseek(fd, dx[dmax].offset, 0);
                                (void) read(fd, (char *)&dx[dmax].jp, sizeof(struct jmp));
                                (void) read(fd, (char *)&dx[(dmax).offset, sizeof(dx[dmax].offset));
                                dx[dmax].ijmp = MAXJMP-1;
                        }
                        else
                                break;
                }
                if (i >= JMPS) {
                        fprintf(stderr, "%s: too many gaps in alignment\n", prog);
                        cleanup(1);
                }
                if (j >= 0) {
                        siz = dx[dmax].jp.n[j];
                        xx = dx[dmax].jp.x[j];
                        dmax += siz;
                        if (siz < 0) {          /* gap in second seq */
                                pp[1].n[i1] =-siz;
                                xx += siz;
                                /* id = xx - yy + len1 - 1
```

TABLE 1-continued

```
                                        */
                                        pp[1].x[i] = xx − dmax + len1 − 1;
                                        gapy++;
                                        ngapy −= siz;
/* ignore MAXGAP when doing endgaps */
                                        siz = (−siz < MAXGAP || endgaps)? −siz : MAXGAP;
                                        i1++;
                                }
                                else if (siz > 0) { /* gap in first seq */
                                        pp[0].n[i0] = siz;
                                        pp[0].x[i0] = xx;
                                        gapx++;
                                        ngapx += siz;
/* ignore MAXGAP when doing endgaps */
                                        siz = (siz < MAXGAP || endgaps)? siz : MAXGAP;
                                        i0++;
                                }
                        }
                        else
                                break;
                }
                /* reverse the order of jmps
                */
                for (j = 0, i0−−; j < i0; j++, i0−−) {
                        i = pp[0].n[j]; pp[0].n[j] = pp[0].n[i0]; pp[0].n[i0] = i;
                        i = pp[0].x[j]; pp[0].x[j] = pp[0].x[i0]; pp[0].x[i0] = i;
                }
                for (j = 0, i1−−; j < i1; j++, i1−−) {
                        i = pp[1].n[j]; pp[1].n[j] = pp[1].n[i1]; pp[1].n[i1] = i;
                        i = pp[1].x[j]; pp[1].x[j] = pp[1].x[i1]; pp[1].x[i1] = i;
                }
                if (fd >= 0)
                        (void) close(fd);
                if (fj) {
                        (void) unlink(jname);
                        fj = 0;
                        offset = 0;
                }
        }
}
/*
* write a filled jmp struct offset of the prev one (if any): nw()
*/
writejmps(ix)                                                                                                               writejmps
        int     ix;
{
        char    *mktemp();
        if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| PRO | XXXXXXXXXXXXXXX | (Length = 15 amino acids) |
|---|---|---|
| Comparison Protein | XXXXXXYYYYYYY | (Length = 12 amino acids) |

% amino acid sequence identity =

(the number of identically matching amino acid residues between the two polypeptide sequences as determined by ALIGN-2) divided by (the total number of amino acid residues of the PRO polypeptide) =

5 divided by 15 = 33.3%

TABLE 3

| PRO | XXXXXXXXXX | (Length = 10 amino acids) |
|---|---|---|
| Comparison Protein | XXXXXXYYYYYYZZYZ | (Length = 15 amino acids) |

% amino acid sequence identity =

(the number of identically matching amino acid residues between the two polypeptide sequences as determined by ALIGN-2) divided by (the total number of amino acid residues of the PRO polypeptide) =

5 divided by 10 = 50%

TABLE 4

| PRO-DNA | NNNNNNNNNNNNNN | (Length = 14 nucleotides) |
|---|---|---|
| Comparison DNA | NNNNNNLLLLLLLLLL | (Length = 16 nucleotides) |

% nucleic acid sequence identity =
(the number of identically matching nucleotides between the two nucleic acid sequences as determined by ALIGN-2) divided by (the total number of nucleotides of the PRO-DNA nucleic acid sequence) =
6 divided by 14 = 42.9%

TABLE 5

| PRO-DNA | NNNNNNNNNNNN | (Length = 12 nucleotides) |
|---|---|---|
| Comparison DNA | NNNNLLLVV | (Length = 9 nucleotides) |

% nucleic acid sequence identity =
(the number of identically matching nucleotides between the two nucleic acid sequences as determined by ALIGN-2) divided by (the total number of nucleotides of the PRO-DNA nucleic acid sequence) =
4 divided by 12 = 33.3%

II. Compositions and Methods of the Invention

A. Full-length PRO Polypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

1. Full-length PRO281 Polypeptides

The present invention provides newly identified and isolated nucleotide sequences encoding polypeptides referred to in the present application as PRO281 (UNQ244). In particular, cDNA encoding a PRO281 polypeptide has been identified and isolated, as disclosed in further detail in the Examples below.

Using the WU-BLAST-2 sequence alignment computer program, it has been found that a full-length native sequence PRO281 (shown in FIG. 2 and SEQ ID NO:2) has certain amino acid sequence identity with the rat TEGT protein. Accordingly, it is presently believed that PRO281 disclosed in the present application is a newly identified TEGT homolog and may possess activity typical of that protein.

2. Full-length PRO276 Polypeptides

The present invention provides newly identified and isolated nucleotide sequences encoding polypeptides referred to in the present application as PRO276 (UNQ243). In particular, cDNA encoding a PRO276 polypeptide has been identified and isolated, as disclosed in further detail in the Examples below.

As far as is known, the DNA16435-1208 sequence encodes a novel factor designated herein as PRO276; using WU-BLAST-2 sequence alignment computer programs, no significant sequence identities to any known proteins were revealed. The sequence identity identifications which were found are listed below in the examples.

3. Full-length PRO189 Polypeptides

The present invention provides newly identified and isolated nucleotide sequences encoding polypeptides referred to in the present application as PRO189. In particular, Applicants have identified and isolated cDNA encoding a PRO189 polypeptide, as disclosed in further detail in the Examples below. To Applicants present knowledge, the DNA21624-1391 nucleotide sequence encodes a novel factor; using BLAST and FastA sequence alignment computer programs, no significant sequence identities to any known proteins were revealed.

4. Full-length PRO190 Polypeptides

The present invention provides newly identified and isolated nucleotide sequences encoding polypeptides referred to in the present application as PRO190. In particular, Applicants have identified and isolated cDNA encoding a PRO190 polypeptide, as disclosed in further detail in the Examples below. The PRO190-encoding clone was isolated from a human retina library. To Applicants present knowledge, the DNA23334-1392 nucleotide sequence encodes a novel multiple transmembrane spanning protein; using BLAST and FastA sequence alignment computer programs, there is some sequence identity with CMP-sialic acid and UDP-galactose transporters, indicating that PRO190 may be related to transporter or that PRO190 may be a novel transporter.

5. Full-length PRO341 Polypeptides

The present invention provides newly identified and isolated nucleotide sequences encoding polypeptides referred to in the present application as PRO341 (UNQ300). In particular, cDNA encoding a PRO341 polypeptide has been identified and isolated, as disclosed in further detail in the Examples below.

The DNA26288-1239 clone was isolated from a human placenta library. As far as is known, the DNA26288-1239 sequence encodes a novel factor designated herein as PRO341; using the WU-BLAST-2 sequence alignment computer program, no significant sequence identities to any known proteins were revealed.

6. Full-length PRO180 Polypeptides

The present invention provides newly identified and isolated nucleotide sequences encoding polypeptides referred to in the present application as PRO180 (UNQ154). In particular, cDNA encoding a PRO180 polypeptide has been identified and isolated, as disclosed in further detail in the Examples below.

The DNA26843-1389 clone was isolated from a human placenta library using oligos formed from DNA12922 isolated from an amylase screen. As far as is known, the DNA26843-1389 sequence encodes a novel factor designated herein as PRO180.

7. Full-length PRO194 Polypeptides

The present invention provides newly identified and isolated nucleotide sequences encoding polypeptides referred to in the present application as PRO194. In particular, Applicants have identified and isolated cDNA encoding a PRO194 polypeptide, as disclosed in further detail in the Examples below. The PRO194-encoding clone was isolated from a human fetal lung library. To Applicants present knowledge, the DNA26844-1394 nucleotide sequence encodes a novel factor; using BLAST and FastA sequence alignment computer programs, no significant sequence identities to any known proteins were revealed.

8. Full-length PRO203 Polypeptides

The present invention provides newly identified and isolated nucleotide sequences encoding polypeptides referred to in the present application as PRO203. In particular, Applicants have identified and isolated cDNA encoding a PRO203 polypeptide, as disclosed in further detail in the Examples below. Using BLAST and FastA sequence alignment computer programs, Applicants found that the PRO203 polypeptide has sequence identity with GST ATPase. Accordingly, it is presently believed that PRO203 polypeptide disclosed in the present application is a newly identified member of the ATPase family and possesses activity typical of the GST ATPase.

9. Full-length PRO290 Polypeptides

The present invention provides newly identified and isolated nucleotide sequences encoding polypeptides referred to in the present application as PRO290. In particular, cDNA encoding a PRO290 polypeptide has been identified and isolated, as disclosed in further detail in the Examples below.

An analysis of the Dayhoff database (version 35.45 SwissProt 35), using a WU-BLAST2 sequence alignment analysis of the full-length sequence shown in FIG. 23 (SEQ ID NO:33), revealed sequence identities between the PRO290 amino acid sequence and the following Dayhoff sequences: P_R99800, CC4H_HUMAN, YCS2_YEAST, CEF35G12_13, HSFAN_1, MMU52461_1, MMU70015_1, HSU67615_1, CET01H10_8 and CELT28F2_6.

It is currently believed that PRO290 is an intracellular protein related to one or more of the above proteins.

10. Full-length PRO874 Polypeptides

The present invention provides newly identified and isolated nucleotide sequences encoding polypeptides referred to in the present application as PRO874. In particular, Applicants have identified and isolated cDNA encoding a PRO874 polypeptide, as disclosed in further detail in the Examples below. The PRO874-encoding clone was isolated from a human fetal lung library. To Applicants present knowledge, the DNA40621-1440 nucleotide sequence encodes a novel factor. Although, using BLAST and FastA sequence alignment computer programs, some sequence identity with known proteins was revealed.

11. Full-length PRO710 Polypeptides

The present invention provides newly identified and isolated nucleotide sequences encoding polypeptides referred to in the present application as PRO710. In particular, Applicants have identified and isolated cDNA encoding a PRO710 polypeptide, as disclosed in further detail in the Examples below. Using BLAST and FastA sequence alignment computer programs, Applicants found that the PRO710 polypeptide has significant similarity to the CDC45 protein. Accordingly, it is presently believed that PRO710 polypeptide disclosed in the present application is a newly identified CDC45 homolog.

12. Full-length PRO1151 Polypeptides

The present invention provides newly identified and isolated nucleotide sequences encoding polypeptides referred to in the present application as PRO1151. In particular, cDNA encoding a PRO1151 polypeptide has been identified and isolated, as disclosed in further detail in the Examples below.

Using the WU-BLAST-2 sequence alignment computer program, it has been found that a full-length native sequence PRO1151 (shown in FIG. 30 and SEQ ID NO:47) has certain amino acid sequence identity with the human 30 kD adipocyte complement-related precursor protein (ACR3_HUMAN). Accordingly, it is presently believed that PRO1151 disclosed in the present application is a newly identified member of the complement protein family and may possess activity typical of that family.

13. Full-length PRO1282 Polypeptides

The present invention provides newly identified and isolated nucleotide sequences encoding polypeptides referred to in the present application as PRO1282. In particular, cDNA encoding a PRO1282 polypeptide has been identified and isolated, as disclosed in further detail in the Examples below.

As far as is known, the DNA45495-1550 sequence encodes a novel factor designated herein as PRO1282. Using WU-BLAST-2 sequence alignment computer programs, some sequence identities between PRO1282 and other leucine rich repeat proteins were revealed, as discussed in the examples below, indicating that a novel member of the leucine rich repeat superfamily has been identified.

14. Full-length PRO358 Polypeptides

The present invention further provides newly identified and isolated nucleotide sequences encoding a polypeptide referred to in the present application as PRO358. In particular, Applicants have identified and isolated cDNA encoding a novel human Toll polypeptide (PRO358), as disclosed in further detail in the Examples below. Using BLAST and FastA sequence alignment computer programs, Applicants found that the coding sequence of PRO358 shows significant homology to DNA sequences HSU88540_1, HSU88878_1, HSU88879_1, HSU88880_1, HS88881_1, and HSU79260_1 in the GenBank database. With the exception of HSU79260_1, the noted proteins have been identified as human toll-like receptors.

Accordingly, it is presently believed that the PRO358 proteins disclosed in the present application are newly identified human homologues of the *Drosophila* protein Toll, and are likely to play an important role in adaptive immunity. More specifically, PRO358 may be involved in inflammation, septic shock, and response to pathogens, and play possible roles in diverse medical conditions that are aggravated by immune response, such as, for example, diabetes, ALS, cancer, rheumatoid arthritis, and ulcers. The role of PRO385 as pathogen pattern recognition receptors, sensing the presence of conserved molecular structures present on microbes, is further supported by the data disclosed in the present application, showing that a known human Toll-like receptor, TLR2 is a direct mediator of LPS signaling.

15. Full-length PRO1310 Polypeptides

The present invention provides newly identified and isolated nucleotide sequences encoding polypeptides referred to in the present application as PRO1310. In particular, cDNA encoding a PRO1310 polypeptide has been identified and isolated, as disclosed in further detail in the Examples below.

Using WU-BLAST-2 sequence alignment computer programs, it has been found that a full-length native sequence PRO1310 (shown in FIG. 36 and SEQ ID NO:62) has certain amino acid sequence identity with carboxypeptidase X2. Accordingly, it is presently believed that PRO1310 disclosed in the present application is a newly identified member of the carboxypeptidase family and may possess carboxyl end amino acid removal activity.

16. Full-length PRO698 Polypeptides

The present invention provides newly identified and isolated nucleotide sequences encoding polypeptides referred to in the present application as PRO698. In particular, Applicants have identified and isolated cDNA encoding a PRO698 polypeptide, as disclosed in further detail in the Examples below. Using BLAST and FastA sequence alignment computer programs, Applicants found that the PRO698 polypeptide has significant similarity to the olfactomedin protein. Accordingly, it is presently believed that PRO698 polypeptide disclosed in the present application may be a newly identified olfactomedin homolog.

17. Full-length PRO732 Polypeptides

The present invention provides newly identified and isolated nucleotide sequences encoding polypeptides referred to in the present application as PRO732. In particular, Applicants have identified and isolated cDNA encoding a PRO732 polypeptide, as disclosed in further detail in the Examples below. Using BLAST and FastA sequence alignment computer programs, Applicants found that the PRO732 polypeptide has significant similarity to the human placental Diff33 protein. Accordingly, it is presently believed that PRO732 polypeptide disclosed in the present application is a newly identified Diff33 homolog.

18. Full-length PRO1120 Polypeptides

The present invention provides newly identified and isolated nucleotide sequences encoding polypeptides referred to in the present application as PRO1120. In particular, cDNA encoding a PRO1120 polypeptide has been identified and isolated, as disclosed in further detail in the Examples below.

Using WU-BLAST-2 sequence alignment computer programs, it has been found that a full-length native sequence PRO1120 (shown in FIG. 47 and SEQ ID NO:84) has certain amino acid sequence identity with the known sulfatase proteins designated CELK09C4_1, and GL6S_HUMAN, respectively, in the Dayhoff database (version 35.45 SwissProt 35). Accordingly, it is presently believed that PRO1120 disclosed in the present application is a newly identified member of the sulfatase family and may possess activity typical of sulfatases.

19. Full-length PRO537 Polypeptides

The present invention provides newly identified and isolated nucleotide sequences encoding polypeptides referred to in the present application as PRO537. In particular, cDNA encoding a PRO537 polypeptide has been identified and isolated, as disclosed in further detail in the Examples below. The DNA49141-1431 clone was isolated from a human placenta library using a trapping technique which selects for nucleotide sequences encoding secreted proteins. Thus, the DNA49141-1431 clone does encode a secreted factor. As far as is known, the DNA49141-1431 sequence encodes a novel factor designated herein as PRO537; using the WU-BLAST2 sequence alignment computer program, no significant sequence identities to any known proteins were revealed.

20. Full-length PRO536 Polypeptides

The present invention provides newly identified and isolated nucleotide sequences encoding polypeptides referred to in the present application as PRO536. In particular, cDNA encoding a PRO536 polypeptide has been identified and isolated, as disclosed in further detail in the Examples below.

The DNA49142-1430 clone was isolated from a human infant brain library using a trapping technique which selects for nucleotide sequences encoding secreted proteins. Thus, the DNA49142-1430 clone does encode a secreted factor. As far as is known, the DNA49142-1430 sequence encodes a novel factor designated herein as PRO536; using the WU-BLAST-2 sequence alignment computer program, no significant sequence identities to any known proteins were revealed.

21. Full-length PRO535 Polypeptides

The present invention provides newly identified and isolated nucleotide sequences encoding polypeptides referred to in the present application as PRO535. In particular, cDNA encoding a PRO535 polypeptide has been identified and isolated, as disclosed in further detail in the Examples below.

Using the WU-BLAST2 sequence alignment computer program, it has been found that a full-length native sequence PRO535 (shown in FIG. 53 and SEQ ID NO:99) has amino acid sequence identity with a putative peptidyl-prolyl isomerase protein. Accordingly, it is presently believed that PRO535 disclosed in the present application is a newly identified member of the isomerase protein family and may possess activity typical of those proteins.

22. Full-length PRO718 Polypeptides

The present invention provides newly identified and isolated nucleotide sequences encoding polypeptides referred to in the present application as PRO718. In particular, Applicants have identified and isolated cDNA encoding a PRO718 polypeptide, as disclosed in further detail in the Examples below. The PRO718-encoding clone was isolated from a human fetal lung library. To Applicants present knowledge, the DNA49647-1398 nucleotide sequence encodes a novel factor; using BLAST and FastA sequence alignment computer programs, no significant sequence identities to any known proteins were revealed.

23. Full-length PRO872 Polypeptides

The present invention provides newly identified and isolated nucleotide sequences encoding polypeptides referred to in the present application as PRO872. In particular, Applicants have identified and isolated cDNA encoding a PRO872 polypeptide, as disclosed in further detail in the Examples below. Using BLAST and FastA sequence alignment computer programs, Applicants found that the PRO872 polypeptide has sequence identity with dehydrogenases. Accordingly, it is presently believed that PRO872 polypeptide disclosed in the present application is a newly identified member of the dehydrogenase family and possesses dehydrogenase activity.

24. Full-length PRO1063 Polypeptides

The present invention provides newly identified and isolated nucleotide sequences encoding polypeptides referred to in the present application as PRO1063. In particular, Applicants have identified and isolated cDNA encoding a PRO1063 polypeptide, as disclosed in further detail in the Examples below. Using BLAST and FastA sequence alignment computer programs, Applicants found that the PRO1063 polypeptide has significant similarity to the human type IV collagenase protein. Accordingly, it is presently believed that PRO1063 polypeptide disclosed in the present application is a newly identified collagenase homolog.

25. Full-length PRO619 Polypeptides

The present invention provides newly identified and isolated nucleotide sequences encoding polypeptides referred to in the present application as PRO619. In particular, cDNA encoding a PRO619 polypeptide has been identified and isolated, as disclosed in further detail in the Examples below.

Using WU-BLAST-2 sequence alignment computer program, it has been found that a full-length native sequence PRO619 (shown in FIG. 68 and SEQ ID NO:117) has certain amino acid sequence identity with VpreB3. Accordingly, it is presently believed that PRO619 disclosed in the present application is a newly identified member of the IgG superfamily and may possess activity related to the assembly and/or components of the surrogate light chain associated with developing B cells.

26. Full-length PRO943 Polypeptides

The present invention provides newly identified and isolated nucleotide sequences encoding polypeptides referred to in the present application as PRO943. In particular, cDNA encoding a PRO943 polypeptide has been identified and isolated, as disclosed in further detail in the Examples below.

Using the WU-BLAST-2 sequence alignment computer program, it has been found that a full-length native sequence PRO943 (shown in FIG. 70 and SEQ ID NO:119) has amino acid sequence identity with the fibroblast growth factor receptor-4 protein. Accordingly, it is presently believed that PRO943 disclosed in the present application is a newly identified member of the fibrobalst growth factor receptor family and may possess activity typical of that family.

27. Full-length PRO1188 Polypeptides

The present invention provides newly identified and isolated nucleotide sequences encoding polypeptides referred to in the present application as PRO1188. In particular, cDNA encoding a PRO1188 polypeptide has been identified and isolated, as disclosed in further detail in the Examples below.

As discussed in more detail in Example 1 below, using WU-BLAST-2 sequence alignment computer programs, it has been found that a full-length native sequence PRO1188 (shown in FIG. 72; SEQ ID NO:124) has certain amino acid sequence identity with nucleotide pyrophosphohydrolase (SSU83114_1). Accordingly, it is presently believed that PRO1188 disclosed in the present application is a newly identified member of the nucleotide pyrophosphohydrolase family and may possess activity typical of that family of proteins.

28. Full-length PRO1133 Polypeptides

The present invention provides newly identified and isolated nucleotide sequences encoding polypeptides referred to in the present application as PRO1133. In particular, cDNA encoding a PRO1133 polypeptide has been identified and isolated, as disclosed in further detail in the Examples below.

Using WU-BLAST-2 sequence alignment computer programs, it has been found that a full-length native sequence PRO1133 (shown in FIG. 74 and SEQ ID NO:129) has certain amino acid sequence identity with netrin 1a, Dayhoff accession AF002717_1. Accordingly, it is presently believed that PRO1133 disclosed in the present application shares at least one related mechanism with netrin.

29. Full-length PRO784 Polypeptides

The present invention provides newly identified and isolated nucleotide sequences encoding polypeptides referred to in the present application as PRO784. In particular, cDNA, designated herein as "DNA53978-1443", which encodes a PRO784 polypeptide, has been identified and isolated, as disclosed in further detail in the Examples below.

Using BLAST and FastA sequence alignment computer programs, it has been found that a full-length native sequence PRO784 (shown in FIG. 76 and SEQ ID NO:135) has certain amino acid sequence identity with sec22 homologs. Accordingly, it is presently believed that PRO784 disclosed in the present application is a newly identified member of the sec22 family and may possess vesicle trafficking activities typical of the sec22 family.

30. Full-length PRO783 Polypeptides

The present invention provides newly identified and isolated nucleotide sequences encoding polypeptides referred to in the present application as PRO783. In particular, Applicants have identified and isolated cDNA encoding a PRO783 polypeptide, as disclosed in further detail in the Examples below. The PRO783-encoding clone was isolated from a human fetal kidney library. To Applicants present knowledge, the DNA53996-1442 nucleotide sequence encodes a novel factor. However, using BLAST and FastA sequence alignment computer programs, some sequence identity to known proteins was found.

31. Full-length PRO820 Polypeptides

The present invention provides newly identified and isolated nucleotide sequences encoding polypeptides referred to in the present application as PRO820. In particular, Applicants have identified and isolated cDNA encoding a PRO820 polypeptide, as disclosed in further detail in the Examples below. Using BLAST and FastA sequence alignment computer programs, Applicants found that various portions of the PRO820 polypeptide have sequence identity with the low affinity immunoglobulin gamma Fc receptor, the IgE high affinity Fc receptor and the high affinity immunoglobulin epsilon receptor. Accordingly, it is presently believed that PRO820 polypeptide disclosed in the present application is a newly identified member of the Fc receptor family.

32. Full-length PRO1080 Polypeptides

The present invention provides newly identified and isolated nucleotide sequences encoding polypeptides referred to in the present application as PRO1080. In particular, Applicants have identified and isolated cDNA encoding a PRO1080 polypeptide, as disclosed in further detail in the Examples below. Using BLAST and FastA sequence alignment computer programs, Dayhoff database (version 35.45 SwissProt 35), Applicants found that the PRO1080 polypeptide has sequence identity with a 39.9 kd protein designated as "YRY1_CAEEL", a DnaJ homolog designated "AF027149_5", a DnaJ homolog 2 designated "RNU95727_1", and Dna3/Cpr3 designated "AF011793_1". Accordingly, these results indicate that the PRO1080 polypeptide disclosed in the present application may be a newly identified member of the DnaJ-like protein family and therefore may be involved in protein biogenesis.

33. Full-length PRO1079 Polypeptides

The present invention provides newly identified and isolated nucleotide sequences encoding polypeptides referred to in the present application as PRO1079. In particular, cDNA encoding a PRO1079 polypeptide has been identified and isolated, as disclosed in further detail in the Examples below.

As far as is known, the DNA56050-1455 sequence encodes a novel factor designated herein as PRO1079. Although, using WU-BLAST2 sequence alignment computer programs, some sequence identities to known proteins was revealed.

34. Full-length PRO793 Polypeptides

The present invention provides newly identified and isolated nucleotide sequences encoding polypeptides referred to in the present application as PRO793. In particular, cDNA encoding a PRO793 polypeptide has been identified and isolated, as disclosed in further detail in the Examples below.

The DNA56110-1437 clone was isolated from a human skin tumor library. As far as is known, the DNA56110-1437 sequence encodes a novel factor designated herein as PRO793; using the WU-BLAST-2 sequence alignment computer program, no significant sequence identities to any known proteins were revealed.

35. Full-length PRO1016 Polypeptides

The present invention provides newly identified and isolated nucleotide sequences encoding polypeptides referred to in the present application as PRO1016. In particular, Applicants have identified and isolated cDNA encoding a PRO1016 polypeptide, as disclosed in further detail in the Examples below. Using BLAST and FastA sequence alignment computer programs, Applicants found that various portions of the PRO1016 polypeptide have sequence identity with acyltransferases. Accordingly, it is presently believed that PRO1016 polypeptide disclosed in the present application is a newly identified member of the acyltransferase family and possesses acyltalation capabilities typical of this family.

36. Full-length PRO1013 Polypeptides

The present invention provides newly identified and isolated nucleotide sequences encoding polypeptides referred to in the present application as PRO1013. In particular, Applicants have identified cDNA encoding a PRO1013 polypeptide, as disclosed in further detail in the Examples below. The PRO1013-encoding clone came from a human breast tumor tissue library. Thus, the PRO1013-encoding clone may encode a secreted factor related to cancer. To Applicants present knowledge, the DNA56410-1414 nucleotide sequence encodes a novel factor. Using BLAST and FastA sequence alignment computer programs, some sequence identity with KIAA0157 and P120 was revealed. PRO1013 has at least one region in common with growth factor and cytokine receptors.

37. Full-length PRO937 Polypeptides

The present invention provides newly identified and isolated nucleotide sequences encoding polypeptides referred to in the present application as PRO937. In particular, Applicants have identified and isolated cDNA encoding a PRO937 polypeptide, as disclosed in further detail in the Examples below. Using BLAST and FastA sequence alignment computer programs, Applicants found that the PRO937 polypeptide has significant sequence identity with members of the glypican family of proteins. Accordingly, it is presently believed that PRO937 polypeptide disclosed in the present application is a newly identified member of the glypican family possesses properties typical of the glypican family.

38. Full-length PRO842 Polypeptides

The present invention provides newly identified and isolated nucleotide sequences encoding polypeptides referred to in the present application as PRO842. In particular, cDNA encoding a PRO842 polypeptide has been identified and isolated, as disclosed in further detail in the Examples below.

As far as is known, the DNA56855-1447 sequence encodes a novel secreted factor designated herein as PRO842. However, using WU-BLAST2 sequence alignment computer programs, some sequence identity to any known proteins were revealed.

39. Full-length PRO839 Polypeptides

The present invention provides newly identified and isolated nucleotide sequences encoding polypeptides referred to in the present application as PRO839. In particular, cDNA encoding a PRO839 polypeptide has been identified and isolated, as disclosed in further detail in the Examples below.

As far as is known, the DNA56859-1445 sequence encodes a novel factor designated herein as PRO839. However, using WU-BLAST-2 sequence alignment computer programs, some sequence identities to known proteins was revealed.

40. Full-length PRO1180 Polypeptides

The present invention provides newly identified and isolated nucleotide sequences encoding polypeptides referred to in the present application as PRO1180. In particular, Applicants have identified and isolated cDNA encoding a PRO1180 polypeptide, as disclosed in further detail in the Examples below. Using BLAST and FastA sequence alignment computer programs, Applicants found that the PRO1180 polypeptide has significant similarity to methyltransferase enzymes. Accordingly, it is presently believed that PRO1180 polypeptide disclosed in the present application is a newly identified member of the methyltransferase family and possesses activity typical of that family.

41. Full-length PRO1134 Polypeptides

The present invention provides newly identified and isolated nucleotide sequences encoding polypeptides referred to in the present application as PRO1134. In particular, cDNA encoding a PRO1134 polypeptide has been identified and isolated, as disclosed in further detail in the Examples below.

The DNA56865-1491 clone was isolated from a human fetal liver spleen library using a trapping technique which selects for nucleotide sequences encoding secreted proteins. Thus, the DNA56865-1491 clone does encode a secreted factor. As far as is known, the DNA56865-1491 sequence encodes a novel factor designated herein as PRO1134; using the WU-BLAST2 sequence alignment computer program, no significant sequence identities to any known proteins were revealed.

42. Full-length PRO830 Polypeptides

The present invention provides newly identified and isolated nucleotide sequences encoding polypeptides referred to in the present application as PRO830. In particular, cDNA encoding a PRO830 polypeptide has been identified and isolated, as disclosed in further detail in the Examples below.

The DNA56866-1342 clone was isolated from a human fetal liver/spleen library using a trapping technique which selects for nucleotide sequences encoding secreted proteins. Thus, the DNA56866-1342 clone does encode a secreted factor. As far as is known, the DNA56866-1342 sequence encodes a novel factor designated herein as PRO830; using the WU-BLAST-2 sequence alignment computer program, no significant sequence identities to any known proteins were revealed.

43. Full-length PRO1115 Polypeptides

The present invention provides newly identified and isolated nucleotide sequences encoding polypeptides referred to in the present application as PRO1115. In particular, cDNA encoding a PRO1115 polypeptide has been identified and isolated, as disclosed in further detail in the Examples below.

As far as is known, the DNA56868-1478 sequence encodes a novel transmembrane protein designated herein as PRO1115. Although, using WU-BLAST-2 sequence alignment computer programs, some sequence identities to known proteins were revealed.

44. Full-length PRO1277 Polypeptides

The present invention provides newly identified and isolated nucleotide sequences encoding polypeptides referred to in the present application as PRO1277. In particular, cDNA encoding a PRO1277 polypeptide has been identified and isolated, as disclosed in further detail in the Examples below.

Using WU-BLAST-2 sequence alignment computer programs, it has been found that a full-length native sequence PRO1277 (shown in FIG. 113 and SEQ ID NO:179) has certain amino acid sequence identity with Coch-5B2 protein (designated "AF012252_1, in the Dayhoff database). Accordingly, it is presently believed that PRO1277 disclosed in the present application is a newly identified member of the Coch-5B2 protein family and may possess the same activities and properties as Coch-5B2.

45. Full-length PRO1135 Polypeptides

The present invention provides newly identified and isolated nucleotide sequences encoding polypeptides referred to in the present application as PRO1135. In particular, Applicants have identified and isolated cDNA encoding a PRO1135 polypeptide, as disclosed in further detail in the Examples below. Using BLAST and FastA sequence alignment computer programs, Applicants found that the PRO1135 polypeptide has significant similarity to the alpha 1,2-mannosidase protein. Accordingly, it is presently believed that PRO1135 polypeptide disclosed in the present application is a newly identified member of the mannosidase enzyme family and possesses activity typical of that family of proteins.

46. Full-length PRO1114 Polypeptides

The present invention provides newly identified and isolated nucleotide sequences encoding polypeptides referred to in the present application as PRO1114 interferon receptor. In particular, cDNA encoding a PRO114 interferon receptor polypeptide has been identified and isolated, as disclosed in further detail in the Examples below.

Using the WU-BLAST-2 sequence alignment computer program, it has been found that a full-length native sequence PRO1114 interferon receptor polypeptide (shown in FIG. 117 and SEQ ID NO:183) has sequence identity with the other known interferon receptors. Accordingly, it is presently believed that PRO114 interferon receptor possesses activity typical of other interferon receptors.

47. Full-length PRO828 Polypeptides

The present invention provides newly identified and isolated nucleotide sequences encoding polypeptides referred to in the present application as PRO828. In particular, Applicants have identified and isolated cDNA encoding a PRO828 polypeptide, as disclosed in further detail in the Examples below. Using BLAST and FastA sequence alignment computer programs, Applicants found that the PRO828 polypeptide has sequence identity with glutathione peroxidases. Accordingly, it is presently believed that PRO828 polypeptide disclosed in the present application is a newly identified member of the glutathione peroxidase family and possesses peroxidase activity and other properties typical of glutathione peroxidases.

48. Full-length PRO1009 Polypeptides

The present invention provides newly identified and isolated nucleotide sequences encoding polypeptides referred to in the present application as PRO1009. In particular, cDNA encoding a PRO1009 polypeptide has been identified and isolated, as disclosed in further detail in the Examples below.

Using WU-BLAST-2 sequence alignment computer programs, it has been found that a full-length native sequence PRO1009 (shown in FIG. 122 and SEQ ID NO:194) has certain amino acid sequence identity with long-chain acyl-CoA synthetase homolog designated "F69893". Accordingly, it is presently believed that PRO1009 disclosed in the present application is a newly identified member of the long-chain acyl-CoA synthetase family and may possess activity related to this family.

49. Full-length PRO1007 Polypeptides

The present invention provides newly identified and isolated nucleotide sequences encoding polypeptides referred to in the present application as PRO1007. In particular, Applicants have identified and isolated cDNA encoding a PRO1007 polypeptide, as disclosed in further detail in the Examples below. Using BLAST and FastA sequence alignment computer programs, Applicants found that various portions of the PRO1007 polypeptide have sequence identity with MAGPIAP. Accordingly, it is presently believed that PRO1007 polypeptide disclosed in the present application is a newly identified member of the MAGPIAP family and is associated with metastasis and/or cell signaling and/or cell replication.

50. Full-length PRO1056 Polypeptides

The present invention provides newly identified and isolated nucleotide sequences encoding polypeptides referred to in the present application as PRO1056. In particular, cDNA encoding a PRO1056 polypeptide has been identified and isolated, as disclosed in further detail in the Examples below.

Using the WU-BLAST-2 sequence alignment computer program, it has been found that a full-length native sequence PRO1056 (shown in FIG. 127 and SEQ ID NO:199) has amino acid sequence identity with a chloride channel protein. Accordingly, it is presently believed that PRO1056 disclosed in the present application is a newly identified chloride channel protein homolog.

51. Full-length PRO826 Polypeptides

The present invention provides newly identified and isolated nucleotide sequences encoding polypeptides referred to in the present application as PRO826. In particular, cDNA encoding a PRO826 polypeptide has been identified and isolated, as disclosed in further detail in the Examples below.

The DNA57694-1341 clone was isolated from a human fetal heart library using a trapping technique which selects for nucleotide sequences encoding secreted proteins. Thus, the DNA57694-1341 clone does encode a secreted factor. As far as is known, the DNA57694-1341 sequence encodes a novel factor designated herein as PRO826; using the WU-BLAST-2 sequence alignment computer program, no significant sequence identities to any known proteins were revealed.

52. Full-length PRO819 Polypeptides

The present invention provides newly identified and isolated nucleotide sequences encoding polypeptides referred to in the present application as PRO819. In particular, cDNA encoding a PRO819 polypeptide has been identified and isolated, as disclosed in further detail in the Examples below.

The DNA57695-1340 clone was isolated from a human fetal liver spleen library using a trapping technique which selects for nucleotide sequences encoding secreted proteins. Thus, the DNA57695-1340 clone does encode a secreted factor. As far as is known, the DNA57695-1340 sequence encodes a novel factor designated herein as PRO819; using the WU-BLAST-2 sequence alignment computer program, no significant sequence identities to any known proteins were revealed.

53. Full-length PRO1006 Polypeptides

The present invention provides newly identified and isolated nucleotide sequences encoding polypeptides referred to in the present application as PRO1006. In particular, Applicants have identified and isolated cDNA encoding a PRO1006 polypeptide, as disclosed in further detail in the Examples below. The PRO1006-encoding clone was isolated from a human uterus library. To Applicants present knowledge, the DNA57699-1412 nucleotide sequence encodes a novel factor; using BLAST and FastA sequence alignment computer programs, some sequence identity with a putative tyrosine protein kinase was revealed.

54. Full-length PRO1112 Polypeptides

The present invention provides newly identified and isolated nucleotide sequences encoding polypeptides referred to in the present application as PRO1112. In particular, Applicants have identified cDNA encoding a PRO1112 polypeptide, as disclosed in further detail in Example 1 below. To Applicants present knowledge, the DNA57702-1476 nucleotide sequence encodes a novel factor, although using BLAST and FastA sequence alignment computer programs some sequence identity with other known proteins was found.

55. Full-length PRO1074 Polypeptides

The present invention provides newly identified and isolated nucleotide sequences encoding polypeptides referred to in the present application as PRO1074. In particular, Applicants have identified and isolated cDNA encoding a PRO1074 polypeptide, as disclosed in further detail in the Examples below. Using BLAST and FastA sequence alignment computer programs, Applicants found that the PRO1074 polypeptide has sequence identity with galactosyltransferase. Accordingly, it is presently believed that PRO1074 polypeptide disclosed in the present application is a newly identified member of the galactosyltransferase family and possesses galactosyltransferase activity.

56. Full-length PRO1005 Polypeptides

The present invention provides newly identified and isolated nucleotide sequences encoding polypeptides referred to in the present application as PRO1005. In particular, EDNA encoding a PRO1005 polypeptide has been identified and isolated, as disclosed in further detail in the Examples below.

As far as is known, the DNA57708-1411 sequence encodes a novel factor designated herein as PRO1005. However, using WU-BLAST2 sequence alignment computer programs, some sequence identities with known proteins was revealed.

57. Full-length PRO1073 Polypeptides

The present invention provides newly identified and isolated nucleotide sequences encoding polypeptides referred to in the present application as PRO1073. In particular, cDNA encoding a PRO1073 polypeptide has been identified and isolated, as disclosed in further detail in the Examples below.

As far as is known, the DNA57710 sequence encodes a novel secreted factor designated herein as PRO1073. However, using WU-BLAST2 sequence alignment computer programs, some sequence identities to known proteins were revealed.

58. Full-length PRO1152 Polypeptides

The present invention provides newly identified and isolated nucleotide sequences encoding polypeptides referred to in the present application as PRO1152. In particular, cDNA encoding a PRO1152 polypeptide has been identified and isolated, as disclosed in further detail in the Examples below.

The DNA57711-1501 clone was isolated from a human infant brain library. As far as is known, the DNA57711-1501 sequence encodes a novel factor designated herein as PRO1152; using the WU-BLAST-2 sequence alignment computer program, no significant sequence identities to any known proteins were revealed.

59. Full-length PRO1136 Polypeptides

The present invention provides newly identified and isolated nucleotide sequences encoding polypeptides referred to in the present application as PRO1136. In particular, cDNA encoding a PRO1136 polypeptide has been identified and isolated, as disclosed in further detail in the Examples below.

Using the WU-BLAST2 sequence alignment computer program, it has been found that a full-length native sequence PRO1136 (shown in FIG. 147 and SEQ ID NO:219) has amino acid sequence identity with PDZ domain-containing proteins. Accordingly, it is presently believed that PRO1136 disclosed in the present application is a newly identified member of the PDZ domain-containing protein family and may possess activity typical of that family.

60. Full-length PRO813 Polypeptides

The present invention provides newly identified and isolated nucleotide sequences encoding polypeptides referred to in the present application as PRO813. In particular, Applicants have identified and isolated cDNA encoding a PRO813 polypeptide, as disclosed in further detail in the Examples below. Using BLAST and FastA sequence alignment computer programs, Applicants found that the PRO813 polypeptide has significant similarity to the pulmonary surfactant-associated protein C. Accordingly, it is presently believed that PRO813 polypeptide disclosed in the present application is a newly identified pulmonary surfactant-associated protein C homolog.

61. Full-length PRO809 Polypeptides

The present invention provides newly identified and isolated nucleotide sequences encoding polypeptides referred to in the present application as PRO809. In particular, Applicants have identified and isolated cDNA encoding a PRO809 polypeptide, as disclosed in further detail in the Examples below. To Applicants present knowledge, the DNA57836-1338 nucleotide sequence encodes a novel factor.

62. Full-length PRO791 Polypeptides

The present invention provides newly identified and isolated nucleotide sequences encoding polypeptides referred to in the present application as PRO791. In particular, Applicants have identified and isolated cDNA encoding a PRO791 polypeptide, as disclosed in further detail in the Examples below. To Applicants present knowledge, the DNA57838-1337 nucleotide sequence encodes a novel factor; however, using BLAST and FastA sequence alignment computer programs, there does appear to be some sequence identity with MHC-1 antigens, indicating that PRO791 may be related thereto in structure and function.

63. Full-length PRO1004 Polypeptides

The present invention provides newly identified and isolated nucleotide sequences encoding polypeptides referred to in the present application as PRO1004. In particular, cDNA encoding a PRO1004 polypeptide has been identified and isolated, as disclosed in further detail in the Examples below.

As far as is known, the DNA57844-1410 sequence encodes a novel factor designated herein as PRO1004. However, using WU-BLAST2 sequence alignment computer programs, some sequence identities with known proteins were revealed.

64. Full-length PRO1111 Polypeptides

The present invention provides newly identified and isolated nucleotide sequences encoding polypeptides referred to in the present application as PRO111. In particular, cDNA encoding a PRO1111 polypeptide has been identified and isolated, as disclosed in further detail in the Examples below.

Using WU-BLAST2 sequence alignment computer programs, it has been found that a full-length native sequence PRO1111 (shown in FIG. 157 and SEQ ID NO:229) has certain amino acid sequence identity with LIG. Accordingly, it is presently believed that PRO1111 disclosed in the present application is a newly identified member of this glycoprotein family.

65. Full-length PRO1344 Polypeptides

The present invention provides newly identified and isolated nucleotide sequences encoding polypeptides referred to in the present application as PRO1344. In particular, cDNA encoding a PRO1344 polypeptide has been identified and isolated, as disclosed in further detail in the Examples below.

Using the WU-BLAST2 sequence alignment computer program, it has been found that a full-length native sequence PRO1344 (shown in FIG. 159 and SEQ ID NO:231) has certain amino acid sequence identity with the factor C protein of *Carcinoscorpius rotundicauda*. Accordingly, it is presently believed that PRO1344 disclosed in the present application is a newly identified factor C protein and may possess activity typical of that protein.

66. Full-length PRO1109 Polypeptides

The present invention provides newly identified and isolated nucleotide sequences encoding polypeptides referred to in the present application as PRO1109. In particular, cDNA encoding a PRO1109 polypeptide has been identified and isolated, as disclosed in further detail in the Examples below.

Using the WU-BLAST2 sequence alignment computer program, it has been found that a full-length native sequence PRO1109 (shown in FIG. 161 and SEQ ID NO:236) has certain amino acid sequence identity with the human UDP-Gal:GlcNAc galactosyltransferase protein. Accordingly, it is presently believed that PRO1109 disclosed in the present application is a newly identified β-galactosyltransferase enzyme and has activity typical of those enzymes.

67. Full-length PRO1383 Polypeptides

The present invention provides newly identified and isolated nucleotide sequences encoding polypeptides referred to in the present application as PRO1383. In particular, cDNA encoding a PRO1383 polypeptide has been identified and isolated, as disclosed in further detail in the Examples below.

Using the WU-BLAST2 sequence alignment computer program, it has been found that a full-length native sequence PRO1383 (shown in FIG. 163 and SEQ ID NO:241) has certain amino acid sequence identity with the putative human transmembrane protein nmb precursor (NMB_HUMAN). Accordingly, it is presently believed that PRO1383 disclosed in the present application is a newly identified nmb homolog.

68. Full-length PRO1003 Polypeptides

The present invention provides newly identified and isolated nucleotide sequences encoding polypeptides referred to in the present application as PRO1003. In particular, Applicants have identified and isolated cDNA encoding a PRO1003 polypeptide, as disclosed in further detail in the Examples below. The PRO1003-encoding clone was isolated from a human breast tumor tissue library. The PRO1003-encoding clone was isolated using a trapping technique which selects for nucleotide sequences encoding secreted proteins. Thus, the PRO1003-encoding clone may encode a secreted factor. To Applicants present knowledge, the UNQ487 (DNA58846-1409) nucleotide sequence encodes a novel factor; using BLAST and FastA sequence alignment computer programs, no sequence identities to any known proteins were revealed.

69. Full-length PRO1108 Polypeptides

The present invention provides newly identified and isolated nucleotide sequences encoding polypeptides referred to in the present application as PRO1108. In particular, Applicants have identified and isolated cDNA encoding a PRO1108 polypeptide, as disclosed in further detail in the Examples below. Using BLAST and FastA sequence alignment computer programs, Applicants found that the PRO1108 polypeptide has significant similarity to the LPAAT protein. Accordingly, it is presently believed that PRO1108 polypeptide disclosed in the present application is a newly identified LPAAT homolog.

70. Full-length PRO1137 Polypeptides

The present invention provides newly identified and isolated nucleotide sequences encoding polypeptides referred to in the present application as PRO1137. In particular, Applicants have identified and isolated cDNA encoding a PRO1137 polypeptide, as disclosed in further detail in the Examples below. Using BLAST and FastA sequence alignment computer programs, Applicants found that the PRO1137 polypeptide has sequence identity with ribosyltransferases. Accordingly, it is presently believed that PRO1137 polypeptide disclosed in the present application is a newly identified member of the ribosyltransferase family and possesses ribosyltransferase activity.

71. Full-length PRO1138 Polypeptides

The present invention provides newly identified and isolated nucleotide sequences encoding polypeptides referred to in the present application as PRO1138. In particular, Applicants have identified and isolated cDNA encoding a PRO1138 polypeptide, as disclosed in further detail in the Examples below. Using BLAST and FastA sequence alignment computer programs, Applicants found that the PRO1138 polypeptide has sequence identity with CD84 leukocyte antigen. Accordingly, it is presently believed that PRO1138 polypeptide disclosed in the present application is a newly identified member of the Ig superfamily and has activity typical of other members of the Ig superfamily.

72. Full-length PRO1054 Polypeptides

The present invention provides newly identified and isolated nucleotide sequences encoding polypeptides referred to in the present application as PRO1054. In particular, cDNA encoding a PRO1054 polypeptide has been identified and isolated, as disclosed in further detail in the Examples below.

Using the WU-BLAST2 sequence alignment computer program, it has been found that a full-length native sequence PRO1054 (shown in FIG. 174 and SEQ ID NO:256) has amino acid sequence identity with one or more of the major urinary proteins. Accordingly, it is presently believed that PRO1054 disclosed in the present application is a newly identified member of the MUP family and may possess activity typical of that family.

73. Full-length PRO994 Polypeptides

The present invention provides newly identified and isolated nucleotide sequences encoding polypeptides referred to in the present application as PRO994. In particular, cDNA encoding a PRO994 polypeptide has been identified and isolated, as disclosed in further detail in the Examples below.

Using the WU-BLAST2 sequence alignment computer program, it has been found that a full-length native sequence PRO994 (shown in FIG. 176 and SEQ ID NO:258) has amino acid sequence identity with the tumor-associated antigen L6. Accordingly, it is presently believed that PRO994 disclosed in the present application is a newly identified L6 antigen homolog.

74. Full-length PRO812 Polypeptides

The present invention provides newly identified and isolated nucleotide sequences encoding polypeptides referred to in the present application as PRO812. In particular, cDNA encoding a PRO812 polypeptide has been identified and isolated, as disclosed in further detail in the Examples below.

Using the WU-BLAST2 sequence alignment computer program, it has been found that a full-length native sequence PRO812 (shown in FIG. 178 and SEQ ID NO:260) has amino acid sequence identity with the prostatic steroid-binding c1 protein. Accordingly, it is presently believed that PRO812 disclosed in the present application is a newly identified prostatic steroid-binding c1 protein homolog.

75. Full-length PRO1069 Polypeptides

The present invention provides newly identified and isolated nucleotide sequences encoding polypeptides referred to in the present application as PRO1069. In particular, Applicants have identified and isolated cDNA encoding a PRO1069 polypeptide, as disclosed in further detail in the Examples below. Using BLAST and FastA sequence alignment computer programs, it was found that the PRO1069 polypeptide has sequence identity with CHIF. Accordingly, it is presently believed that PRO1069 polypeptide disclosed in the present application is a newly identified CHIF polypeptide and is involved in ion conductance or regulation of ion conductance.

76. Full-length PRO1129 Polypeptides

The present invention provides newly identified and isolated nucleotide sequences encoding polypeptides referred to in the present application as PRO1129. In particular, Applicants have identified and isolated cDNA encoding a PRO1129 polypeptide, as disclosed in further detail in the Examples below. Using BLAST and FastA sequence alignment computer programs, Applicants found that the PRO1129 polypeptide has significant similarity to the cytochrome P-450 family of proteins. Accordingly, it is presently believed that PRO1129 polypeptide disclosed in the present application is a newly identified member of the cytochrome P-450 family and possesses activity typical of that family.

77. Full-length PRO1068 Polypeptides

The present invention provides newly identified and isolated nucleotide sequences encoding polypeptides referred to in the present application as PRO1068. In particular, cDNA encoding a PRO1068 polypeptide has been identified and isolated, as disclosed in further detail in the Examples below.

Using WU-BLAST2 sequence alignment computer programs, it has been found that a full-length native sequence PRO1068 has amino acid sequence identity with urotensin. Accordingly, it is presently believed that PRO1068 disclosed in the present application is a newly identified member of the urotensin family and may possess activity typical of the urotensin family.

78. Full-length PRO1066 Polypeptides

The present invention provides newly identified and isolated nucleotide sequences encoding polypeptides referred to in the present application as PRO1066. In particular, Applicants have identified and isolated cDNA encoding a PRO1066 polypeptide, as disclosed in further detail in the Examples below. The PRO1066-encoding clone was isolated from a human pancreatic tumor tissue library using a trapping technique which selects for nucleotide sequences encoding secreted proteins. Thus, the PRO1066-encoding clone may encode a secreted factor. To Applicants present knowledge, the DNA59215-1425 nucleotide sequence encodes a novel factor; using BLAST and FastA sequence alignment computer programs, no sequence identities to any known proteins were revealed.

79. Full-length PRO1184 Polypeptides

The present invention provides newly identified and isolated nucleotide sequences encoding polypeptides referred to in the present application as PRO1184. In particular, Applicants have identified cDNA encoding a PRO1184 polypeptide, as disclosed in further detail in the Examples below. To Applicants present knowledge, the DNA59220-1514 nucleotide sequence encodes a novel secreted factor.

80. Full-length PRO1360 Polypeptides

The present invention provides newly identified and isolated nucleotide sequences encoding polypeptides referred to in the present application as PRO1360. In particular, cDNA encoding a PRO1360 polypeptide has been identified and isolated, as disclosed in further detail in the Examples below.

As far as is known, the DNA59488-1603 sequence encodes a novel factor designated herein as PRO1360; using WU-BLAST2 sequence alignment computer programs, no significant sequence identities to any known proteins were revealed. Some sequence identities were revealed, as indicated below in the examples.

81. Full-length PRO1029 Polypeptides

The present invention provides newly identified and isolated nucleotide sequences encoding polypeptides referred to in the present application as PRO1029. In particular, cDNA encoding a PRO1029 polypeptide has been identified and isolated, as disclosed in further detail in the Examples below.

The DNA59493-1420 clone was isolated from a human fetal liver spleen library using a trapping technique which selects for nucleotide sequences encoding secreted proteins. Thus, the DNA59493-1420 clone does encode a secreted factor. As far as is known, the DNA59493-1420 sequence encodes a novel factor designated herein as PRO1029; using the WU-BLAST2 sequence alignment computer program, no sequence identities to any known proteins were revealed.

82. Full-length PRO1139 Polypeptides

The present invention provides newly identified and isolated nucleotide sequences encoding polypeptides referred to in the present application as PRO1139. In particular, Applicants have identified and isolated cDNAs encoding PRO1139, as disclosed in further detail in the Examples below. Using BLAST and FastA sequence alignment computer programs, Applicants found that the human PRO1139 protein originally identified exhibits a significant sequence homology to the a OB receptor associated protein HSOBRGRP_1, described by Bailleul et al., *Nucleic Acids Res.* 25, 2752–2758 (1997) (EMBL Accession No: Y12670).

83. Full-length PRO1309 Polypeptides

The present invention provides newly identified and isolated nucleotide sequences encoding polypeptides referred to in the present application as PRO1309. In particular, cDNA encoding a PRO1309 polypeptide has been identified and isolated, as disclosed in further detail in the Examples below.

Using the WU-BLAST2 sequence alignment computer program, it has been found that a full-length native sequence PRO1309 (shown in FIG. 196 and SEQ ID NO:278) has certain amino acid sequence identity with a protein designated KIAA0416, given the Dayhoff designation AB007876_1. Moreover, PRO1309 has leucine rich repeats, accordingly, it is presently believed that PRO1309 disclosed in the present application is a newly identified member of the leucine rich protein family and may be involved in protein protein interactions.

84. Full-length PRO1028 Polypeptides

The present invention provides newly identified and isolated nucleotide sequences encoding polypeptides referred to in the present application as PRO1028. In particular, Applicants have identified and isolated cDNA encoding a PRO1028 polypeptide, as disclosed in further detail in the Examples below. To Applicants present knowledge, the DNA59603-1419 nucleotide sequence encodes a novel factor. BLAST and FastA sequence alignment computer programs showed some sequence identity with proteins such as those designated "A53050" and EMU39529_1".

85. Full-length PRO1027 Polypeptides

The present invention provides newly identified and isolated nucleotide sequences encoding polypeptides referred to in the present application as PRO1027. In particular, Applicants have identified and isolated cDNA encoding a PRO1027 polypeptide, as disclosed in further detail in the Examples below. The PRO1027-encoding clone was identified in a human uterine cervical tissue library. To Appli-

86. Full-length PRO1107 Polypeptides

The present invention provides newly identified and isolated nucleotide sequences encoding polypeptides referred to in the present application as PRO1107. In particular, Applicants have identified and isolated cDNA encoding a PRO1107 polypeptide, as disclosed in further detail in the Examples below. Using BLAST and FastA sequence alignment computer programs, Applicants found that the PRO1107 polypeptide has some similarity to the PC-1 protein, human insulin receptor tyrosine kinase inhibitor, an alkaline phosphodiesterase, and autotaxin. Accordingly, it is presently believed that PRO1107 polypeptide disclosed in the present application is a newly identified member of the phosphodiesterase family.

87. Full-length PRO1140 Polypeptides

The present invention provides newly identified and isolated nucleotide sequences encoding novel multi-span transmembrane polypeptides referred to in the present application as PRO1140. In particular, Applicants have identified and isolated cDNA encoding a PRO1140 polypeptide, as disclosed in further detail in the Examples below. Using BLAST and FastA sequence alignment computer programs, some sequence identity with known proteins was found.

88. Full-length PRO1106 Polypeptides

The present invention provides newly identified and isolated nucleotide sequences encoding polypeptides referred to in the present application as PRO1106. In particular, Applicants have identified and isolated cDNA encoding a PRO1106 polypeptide, as disclosed in further detail in the Examples below. Using BLAST and FastA sequence alignment computer programs, Applicants found that the PRO1106 polypeptide has significant similarity to the peroxisomal calcium-dependent solute carrier. Accordingly, it is presently believed that PRO1106 polypeptide disclosed in the present application is a newly identified member of the mitochondrial carrier superfamily and possesses transporter activity typical of this family.

89. Full-length PRO1291 Polypeptides

The present invention provides newly identified and isolated nucleotide sequences encoding polypeptides referred to in the present application as PRO1291. In particular, cDNA encoding a PRO1291 polypeptide has been identified and isolated, as disclosed in further detail in the Examples below.

Using the WU-BLAST2 sequence alignment computer program, it has been found that a full-length native sequence PRO1291 (shown in FIG. 208 and SEQ ID NO:291) has certain amino acid sequence identity with the butyrophilin protein. Accordingly, it is presently believed that PRO1291 disclosed in the present application is a newly identified butyrophilin homolog and may possess activity typical of that protein.

90. Full-length PRO1105 Polypeptides

The present invention provides newly identified and isolated nucleotide sequences encoding polypeptides referred to in the present application as PRO1105. In particular, Applicants have identified cDNA encoding a PRO1105 polypeptide, as disclosed in further detail in the Examples below. To Applicants present knowledge, the DNA59612-1466 nucleotide sequence encodes a novel factor. There is, however, some sequence identity with a peroxydase precursor designated in a Dayhoff database as "ATTS1623_1".

91. Full-length PRO511 Polypeptides

The present invention provides newly identified and isolated nucleotide sequences encoding polypeptides referred to in the present application as PRO511. In particular, Applicants have identified and isolated cDNA encoding a PRO511 polypeptide, as disclosed in further detail in the Examples below. The PRO511-encoding clone was isolated from a human colon tissue library. To Applicants present knowledge, the DNA59613-1417 nucleotide sequence encodes a novel factor; using BLAST and FastA sequence alignment computer programs, sequence identities with RoBo-1, phospholipase inhibitors and a protein designated as "SSC20F10_1" were revealed, indicated that PRO511 may be related to one or more of these proteins.

92. Full-length PRO1104 Polypeptides

The present invention provides newly identified and isolated nucleotide sequences encoding polypeptides referred to in the present application as PRO1104. In particular, Applicants have identified and isolated cDNA encoding a PRO1104 polypeptide, as disclosed in further detail in the Examples below. To Applicants present knowledge, the DNA59616-1465 nucleotide sequence encodes a novel factor; using BLAST and FastA sequence alignment computer programs, some sequence identity appeared with proteins designated as "AB002107_1", "AF022991_1" and "SP96_DICDI".

93. Full-length PRO1100 Polypeptides

The present invention provides newly identified and isolated nucleotide sequences encoding polypeptides referred to in the present application as PRO1100. In particular, Applicants have identified cDNA encoding a PRO1100 polypeptide, as disclosed in further detail in the Examples below. To Applicants present knowledge, the DNA59619-1464 nucleotide sequence encodes a novel factor; using BLAST and FastA sequence alignment computer programs, only some sequence identity with known proteins was revealed. There is some sequence identity with the yeast hypothetical 42.5 KD protein in TSM1-ARE1 intergenic region (ACCESSION NO:140496), designated "YSCT4_YEAST".

94. Full-length PRO836 Polypeptides

The present invention provides newly identified and isolated nucleotide sequences encoding polypeptides referred to in the present application as PRO836. In particular, Applicants have identified and isolated cDNA encoding a PRO836 polypeptide, as disclosed in further detail in the Examples below. To Applicants present knowledge, the DNA59620-1463 nucleotide sequence encodes a novel factor. Using BLAST and FastA sequence alignment computer programs, there appears to be some sequence identity with SLS1.

95. Full-length PRO1141 Polypeptides

The present invention provides newly identified and isolated nucleotide sequences encoding polypeptides referred to in the present application as PRO1141. In particular, cDNA encoding a PRO1141 polypeptide has been identified and isolated, as disclosed in further detail in the Examples below.

The DNA59625-1498 clone was isolated from a human ileum tissue library. As far as is known, the DNA59625-1498 sequence encodes a novel factor designated herein as PRO1141; using the WU-BLAST2 sequence alignment computer program, no sequence identities to any known proteins were revealed.

96. Full-length PRO1132 Polypeptides

The present invention provides newly identified and isolated nucleotide sequences encoding polypeptides referred to in the present application as PRO1132. In particular, cDNA encoding a PRO1132 polypeptide has been identified and isolated, as disclosed in further detail in the Examples below.

Using WU-BLAST2 sequence alignment computer program, it has been found that a full-length native sequence PRO1132 (shown in FIG. 226 and SEQ ID NO:309) has certain amino acid sequence identity with enamel matrix serine proteinase 1 and neuropsin. Accordingly, it is presently believed that PRO1132 disclosed in the present application is a newly identified member of the serine protease family and may possess protease activity typical of this family.

97. Full-length PRO1346 Polypeptides

The present invention provides newly identified and isolated nucleotide sequences encoding polypeptides referred to in the present application as NL7 (UNQ701). In particular, cDNA encoding an NL7 polypeptide has been identified and isolated, as disclosed in further detail in the Examples below.

As disclosed in the Examples below, a clone DNA59776-1600 has been deposited with ATCC. The actual nucleotide sequence of the clone can be readily determined by the skilled artisan by sequencing of the deposited clone using routine methods in the art. The predicted amino acid sequence can be determined from the nucleotide sequence using routine skill. For the NL7 (PRO1346) herein, Applicants have identified what is believed to be the reading frame best identifiable with the sequence information available at the time of filing.

Using WU-BLAST2 sequence alignment computer programs, it has been found that a full-length native sequence NL7 (shown in FIG. 228 and SEQ ID NO:314) has certain amino acid sequence identity with microfibril-associated glycoprotein 4 (MFA4_HUMAN); ficolin-A—*Mus musculus* (AB007813_1); human lectin P35 (D63155S6_1); ficolin B—*Mus musculus* (AF0063217_1); human tenascin-R (restriction) (HS518E13_1); the long form of a rat janusin precursor (A45445); fibrinogen-related protein HFREP-1 precursor (JNO596); a human Tenascin precursor (TENA HUMAN); human CDT6 (HSY16132_1); and angiopoietin-1—*Mus musculus* (MMU83509_1). It is presently believed that NL7 disclosed in the present application is a novel TIE ligand homologue, and may play a role in angiogenesis and/or vascular maintenance and/pr wound healing and/or inflammation and/or tumor development and/or growth 98. Full-length PRO1131 Polypeptides The present invention provides newly identified and isolated nucleotide sequences encoding polypeptides referred to in the present application as PRO1131. In particular, cDNA encoding a PRO1131 polypeptide has been identified and isolated, as disclosed in further detail in the Examples below.

Using WU-BLAST2 sequence alignment computer programs, it has been found that a full-length native sequence PRO1131 (shown in FIG. 230 and SEQ ID NO:319) has certain amino acid sequence identity with a lectin-like oxidized LDL receptor. Accordingly, it is presently believed that PRO1131 disclosed in the present application may have at least one mechanism similar to those of the LDL receptors.

99. Full-length PRO1281 Polypeptides

The present invention provides newly identified and isolated nucleotide sequences encoding polypeptides referred to in the present application as PRO1281. In particular, cDNA encoding a PRO1281 polypeptide has been identified and isolated, as disclosed in further detail in the Examples below.

The DNA59820-1549 clone was isolated from a human fetal liver library using a trapping technique which selects for nucleotide sequences encoding secreted proteins. Thus, as far as is known, the DNA59820-1549 sequence encodes a novel factor designated herein as PRO1281. Using WU-BLAST2 sequence alignment computer programs, some sequence identities to known proteins was found, but determined not to be significant.

100. Full-length PRO1064 Polypeptides

The present invention provides newly identified and isolated nucleotide sequences encoding polypeptides referred to in the present application as PRO1064. In particular, cDNA encoding a PRO1064 polypeptide has been identified and isolated, as disclosed in further detail in the Examples below.

The DNA59827-1426 clone was isolated from a human fetal kidney library. As far as is known, the DNA59827-1426 sequence encodes a novel factor designated herein as PRO1064; using the WU-BLAST2 sequence alignment computer program, no significant sequence identities to any known proteins were revealed.

101. Full-length PRO1379 Polypeptides

The present invention provides newly identified and isolated nucleotide sequences encoding polypeptides referred to in the present application as PRO1379. In particular, cDNA encoding a PRO1379 polypeptide has been identified and isolated, as disclosed in further detail in the Examples below.

The DNA59828 clone was isolated from a human fetal kidney library. As far as is known, the PRO1379 polypeptide encoded thereby is a novel secreted factor. Using WU-BLAST2 sequence alignment computer programs, sequence identity was found between PRO1379 and a hypothetical yeast protein "YHY8_YEAST" (Dayhoff database; version 35.45 SwissProt 35), particularly at the C-terminal ends. Sequence homologies with other known proteins were revealed, but determined not to be significant.

102. Full-length PRO844 Polypeptides

The present invention provides newly identified and isolated nucleotide sequences encoding polypeptides referred to in the present application as PRO844. In particular, Applicants have identified and isolated cDNA encoding a PRO844 polypeptide, as disclosed in further detail in the Examples below. Using BLAST and FastA sequence alignment computer programs, Applicants found that the PRO844 polypeptide has sequence identity with serine protease inhibitors. Accordingly, it is presently believed that PRO844 polypeptide disclosed in the present application is a newly identified serine protease inhibitor and is capable of inhibiting serine proteases.

103. Full-length PRO848 Polypeptides

The present invention provides newly identified and isolated nucleotide sequences encoding polypeptides referred to in the present application as PRO848. In particular, Applicants have identified and isolated cDNA encoding a PRO848 polypeptide, as disclosed in further detail in the Examples below. Using BLAST and FastA sequence alignment computer programs, Applicants found that the PRO848 polypeptide has sequence identity with sialyltransferases. Accordingly, it is presently believed that PRO848 polypeptide disclosed in the present application is a newly identified member of the sialyltransferase family and possesses sialylation capabilities as typical of this family.

104. Full-length PRO1097 Polypeptides

The present invention provides newly identified and isolated nucleotide sequences encoding polypeptides referred to in the present application as PRO1097. In particular, Applicants have identified and isolated cDNA encoding a PRO1097 polypeptide, as disclosed in further detail in the Examples below. To Applicants present knowledge, the DNA59841-1460 nucleotide sequence encodes a novel factor. Using BLAST and FastA sequence alignment computer programs, some sequence identity with proteins designated as "CELK05G3_3", "CRU26344_1", "SPBC16C6_8", "P_W13844" and "AF013403" was revealed.

105. Full-length PRO1153 Polypeptides

The present invention provides newly identified and isolated nucleotide sequences encoding polypeptides referred to in the present application as PRO1153. In particular, cDNA encoding a PRO1153 polypeptide has been identified and isolated, as disclosed in further detail in the Examples below.

Using WU-BLAST2 sequence alignment computer programs, it has been found that a full-length native sequence PRO1153 (shown in FIG. 246 and SEQ ID NO:351) has certain amino acid sequence identity with HPBRII-7 protein submitted to the EMBL Data Library June 1992. Accordingly, it is presently believed that PRO1153 disclosed in the present application may be related to HPBRII-7.

106. Full-length PRO1154 Polypeptides

The present invention provides newly identified and isolated nucleotide sequences encoding polypeptides referred to in the present application as PRO1154. In particular, cDNA encoding a PRO1154 polypeptide has been identified and isolated, as disclosed in further detail in the Examples below.

Using WU-BLAST2 sequence alignment computer programs, it has been found that a full-length native sequence PRO1154 (shown in FIG. 248 and SEQ ID NO:353) aligns with a KIAA0525 protein, designated AB011097. PRO1154 has a novel N-terminus of 73 amino acids. Accordingly, PRO1154 is believed to be novel. PRO1154 also has significant sequence identity with aminopeptidase N, insulin-regulated membrane aminopeptidase, throtropin-releasing hormone degrading enzyme and placental leucine aminopeptidase. Therefore, PRO1154 is believed to be a novel aminopeptidase, or peptide which degrades peptides.

107. Full-length PRO1181 Polypeptides

The present invention provides newly identified and isolated nucleotide sequences encoding polypeptides referred to in the present application as PRO1181. In particular, cDNA encoding a PRO1181 polypeptide has been identified and isolated, as disclosed in further detail in the Examples below.

The DNA59847-1511 clone was isolated from a human prostate tissue library using a trapping technique which selects for nucleotide sequences encoding secreted proteins. Thus, the DNA59847-1511 clone does encode a secreted factor. As far as is known, the DNA59847-1511 sequence encodes a novel factor designated herein as PRO1181; using the WU-BLAST2 sequence alignment computer program, no significant sequence identities to any known proteins were revealed.

108. Full-length PRO1182 Polypeptides

The present invention provides newly identified and isolated nucleotide sequences encoding polypeptides referred to in the present application as PRO1182. In particular, cDNA encoding a PRO1182 polypeptide has been identified and isolated, as disclosed in further detail in the Examples below.

Using the WU-BLAST2 sequence alignment computer program, it has been found that a full-length native sequence PRO1182 (shown in FIG. 252 and SEQ ID NO:357) has amino acid sequence identity with the conglutinin protein. Accordingly, it is presently believed that PRO1182 disclosed in the present application is a newly identified conglutinin homolog.

109. Full-length PRO1155 Polypeptides

The present invention provides newly identified and isolated nucleotide sequences encoding polypeptides referred to in the present application as PRO1155. In particular, cDNA encoding a PRO1155 polypeptide has been identified and isolated, as disclosed in further detail in the Examples below.

Using WU-BLAST2 sequence alignment computer programs, it has been found that a full-length native sequence PRO1155 (shown in FIG. 254 and SEQ ID NO:359) has certain amino acid sequence identity with neurokinin B. Accordingly, it is presently believed that PRO1155 disclosed in the present application is a newly identified member of the tachykinin family.

110. Full-length PRO1156 Polypeptides

The present invention provides newly identified and isolated nucleotide sequences encoding polypeptides referred to in the present application as PRO1156. In particular, cDNA encoding a PRO1156 polypeptide has been identified and isolated, as disclosed in further detail in the Examples below.

The DNA59853-1505 clone was isolated from an adult human heart library using a trapping technique which selects for nucleotide sequences encoding secreted proteins. Thus, the DNA59853-1505 clone may encode a secreted factor. As far as is known, the DNA59853-1505 sequence encodes a novel factor designated herein as PRO1156. However, using WU-BLAST2 sequence alignment computer programs, some sequence identity with known proteins were revealed.

111. Full-length PRO1098 Polypeptides

The present invention provides newly identified and isolated nucleotide sequences encoding polypeptides referred to in the present application as PRO1098. In particular, Applicants have identified cDNA encoding a PRO1098 polypeptide, as disclosed in further detail in the Examples below. The PRO1098-encoding clone was isolated from a human lung tissue library. To Applicants present knowledge, the DNA59854-1459 nucleotide sequence encodes a novel factor; using BLAST and FastA sequence alignment computer programs, no significant sequence identities to any known proteins were revealed. Some sequence identity appeared with proteins such as the "Env" polyprotein and a methyltransferase.

112. Full-length PRO1127 Polypeptides

The present invention provides newly identified and isolated nucleotide sequences encoding polypeptides referred to in the present application as PRO1127. In particular, cDNA encoding a PRO1127 polypeptide has been identified and isolated, as disclosed in further detail in the Examples below.

The DNA60283-1484 clone encodes a secreted factor. As far as is known, the DNA60283-1484 sequence encodes a novel factor designated herein as PRO1127; using WU-BLAST2 sequence alignment computer programs, minimal sequence identities to any known proteins were revealed.

113. Full-length PRO1126 Polypeptides

The present invention provides newly identified and isolated nucleotide sequences encoding polypeptides referred to in the present application as PRO1126. In particular, cDNA encoding a PRO1126 polypeptide has been identified and isolated, as disclosed in further detail in the Examples below.

Using the WU-BLAST2 sequence alignment computer program, it has been found that a full-length native sequence PRO1126 (shown in FIG. 262 and SEQ ID NO:367) has certain amino acid sequence identity with the olfactomedin protein. Accordingly, it is presently believed that PRO1126 disclosed in the present application is a newly identified olfactomedin homolog and may possess activity typical of that protein.

114. Full-length PRO1125 Polypeptides

The present invention provides newly identified and isolated nucleotide sequences encoding polypeptides referred to in the present application as PRO1125. In particular, cDNA encoding a PRO1125 polypeptide has been identified and isolated, as disclosed in further detail in the Examples below.

Using WU-BLAST2 sequence alignment computer programs, it has been found that a full-length native sequence PRO1125 (shown in FIG. 264 and SEQ ID NO:369) has certain amino acid sequence identity with transcriptional repressor rco-1. Accordingly, it is presently believed that PRO1125 disclosed in the present application is a newly identified member of the WD superfamily.

115. Full-length PRO1186 Polypeptides

The present invention provides newly identified and isolated nucleotide sequences encoding polypeptides referred to in the present application as PRO1186. In particular, cDNA encoding a PRO1186 polypeptide has been identified and isolated, as disclosed in further detail in the Examples below.

Using WU-BLAST2 sequence alignment computer programs, it has been found that a full-length native sequence PRO1186 (shown in FIG. 266 and SEQ ID NO:371) has amino acid sequence identity with venom protein A from *Dendroaspis polylepsis polylepsis* venom. Accordingly, it is presently believed that PRO1186 disclosed in the present application is a newly identified member of venom protein A and may share a related mechanism.

116. Full-length PRO1198 Polypeptides

The present invention provides newly identified and isolated nucleotide sequences encoding polypeptides referred to in the present application as PRO1198. In particular, cDNA encoding a PRO1198 polypeptide has been identified and isolated, as disclosed in further detail in the Examples below.

As far as is known, the DNA60622-1525 sequence encodes a novel factor designated herein as PRO1198. However, using WU-BLAST2 sequence alignment computer programs, some sequence identity with known proteins was found.

117. Full-length PRO1158 Polypeptides

The present invention provides newly identified and isolated nucleotide sequences encoding polypeptides referred to in the present application as PRO1158. In particular, cDNA encoding a PRO1158 polypeptide has been identified and isolated, as disclosed in further detail in the Examples below.

The DNA60625-1507 clone was isolated from a human lung tumor tissue library. As far as is known, the DNA60625-1507 sequence encodes a novel factor designated herein as PRO1158. However, using WU-BLAST2 sequence alignment computer programs, some sequence identities with known proteins were shown.

118. Full-length PRO1159 Polypeptides

The present invention provides newly identified and isolated nucleotide sequences encoding polypeptides referred to in the present application as PRO1159. In particular, cDNA encoding a PRO1159 polypeptide has been identified and isolated, as disclosed in further detail in the Examples below.

The DNA60627-1508 clone was isolated from a human peripheral blood granulocyte tissue library using a trapping technique which selects for nucleotide sequences encoding secreted proteins. Thus, the DNA60627-1508 clone does encode a secreted factor. As far as is known, the DNA60627-1508 sequence encodes a novel factor designated herein as PRO1159; using the WU-BLAST2 sequence alignment computer program, no sequence identities to any known proteins were revealed.

119. Full-length PRO1124 Polypeptides

The present invention provides newly identified and isolated nucleotide sequences encoding polypeptides referred to in the present application as PRO1124. In particular, cDNA encoding a PRO1124 polypeptide has been identified and isolated, as disclosed in further detail in the Examples below.

Using WU-BLAST2 sequence alignment computer programs, it has been found that a full-length native sequence PRO1124 (shown in FIG. 274 and SEQ ID NO:377) has amino acid sequence identity with an epithelial chloride channel protein from *bos taurus*. PRO1124 also has sequence identity with ECAM-1. Accordingly, it is presently believed that PRO1124 disclosed in the present application is a newly identified cell membrane protein involved in communication of cells either through ion channels or cell adhesion molecules.

120. Full-length PRO1287 Polypeptides

The present invention provides newly identified and isolated nucleotide sequences encoding polypeptides referred to in the present application as PRO1287. In particular, cDNA encoding a PRO1287 polypeptide has been identified and isolated, as disclosed in further detail in the Examples below.

Using the WU-BLAST2 sequence alignment computer program, it has been found that a full-length native sequence PRO1287 (shown in FIG. 276 and SEQ ID NO:381) has amino acid sequence identity with the radical fringe protein from *Gallus gallus* (GGU82088_1). Accordingly, it is presently believed that PRO1287 disclosed in the present application is a newly identified fringe protein homolog and may possess activity typical of the fringe protein.

121. Full-length PRO1312 Polypeptides

The present invention provides newly identified and isolated nucleotide sequences encoding polypeptides referred to in the present application as PRO1312. In particular, cDNA encoding a PRO1312 polypeptide has been identified and isolated, as disclosed in further detail in the Examples below.

Using WU-BLAST2 sequence alignment computer programs, some sequence identities with known proteins were revealed, but were determined not to be significant. Therefore, as far as is known, the DNA61873-1574 sequence encodes a novel transmembrane protein designated herein as PRO1312.

122. Full-length PRO1192 Polypeptides

The present invention provides newly identified and isolated nucleotide sequences encoding polypeptides referred to in the present application as PRO1192. In particular, cDNA encoding a PRO1192 polypeptide has been identified and isolated, as disclosed in further detail in the Examples below.

Using WU-BLAST2 sequence alignment computer programs, it has been found that a full-length native sequence PRO1192 (shown in FIG. 280 and SEQ ID NO:389) has amino acid sequence identity with trout P0-like glycoprotein (GEN12838 IP1). Accordingly, it is presently believed that PRO1192 disclosed in the present application is a newly identified member of the myelin P0 glycoprotein family.

123. Full-length PRO1160 Polypeptides

The present invention provides newly identified and isolated nucleotide sequences encoding polypeptides referred to in the present application as PRO1160. In particular, cDNA encoding a PRO1160 polypeptide has been identified and isolated, as disclosed in further detail in the Examples below.

The DNA62872-1509 clone was isolated from a human breast tissue library using a trapping technique which selects for nucleotide sequences encoding secreted proteins. Thus, the DNA62872-1509 clone does encode a secreted factor. As far as is known, the DNA62872-1509 sequence encodes a novel factor designated herein as PRO1160; using the WU-BLAST2 sequence alignment computer program, no significant sequence identities to any known proteins were revealed.

124. Full-length PRO1187 Polypeptides

The present invention provides newly identified and isolated nucleotide sequences encoding polypeptides referred to in the present application as PRO1187. In particular, cDNA encoding a PRO1187 polypeptide has been identified and isolated, as disclosed in further detail in the Examples below.

As far as is known, the DNA62876-1517 sequence encodes a novel factor designated herein as PRO1187; using WU-BLAST2 sequence alignment computer programs, no significant sequence identities to any known proteins were revealed.

125. Full-length PRO1185 Polypeptides

The present invention provides newly identified and isolated nucleotide sequences encoding polypeptides referred to in the present application as PRO1185. In particular, cDNA encoding a PRO1185 polypeptide has been identified and isolated, as disclosed in further detail in the Examples below.

As far as is known, the DNA62881-1515 clone encodes a novel factor designated herein as PRO1185; using WU-BLAST2 sequence alignment computer programs, no significant sequence identities to any known proteins were revealed.

126. Full-length PRO1345 Polypeptides

The present invention provides newly identified and isolated nucleotide sequences encoding polypeptides referred to in the present application as PRO1345. In particular, cDNA encoding a PRO1345 polypeptide has been identified and isolated, as disclosed in further detail in the Examples below.

Using the WU-BLAST2 sequence alignment computer program, it has been found that a full-length native sequence PRO1345 (shown in FIG. 288 and SEQ ID NO:403) has amino acid sequence identity with the C-type lectin homolog precursor protein of bos taurus (BTU22298_1). Accordingly, it is presently believed that PRO1345 disclosed in the present application is a newly identified member of the C-type lectin protein family and may possess activity typical of that family or of the tetranectin protein in particular.

127. Full-length PRO1245 Polypeptides

The present invention provides newly identified and isolated nucleotide sequences encoding polypeptides referred to in the present application as PRO1245. In particular, cDNA encoding a PRO1245 polypeptide has been identified and isolated, as disclosed in further detail in the Examples below.

The DNA64884-1527 clone was identified using methods that selects for nucleotide sequences encoding secreted proteins. As far as is known, the DNA64884-1527 sequence encodes a novel secreted factor designated herein as PRO1245. Using WU-BLAST2 sequence alignment computer programs, some sequence identities to known proteins were revealed; however, it was determined that they were not significant.

128. Full-length PRO1358 Polypeptides

The present invention provides newly identified and isolated nucleotide sequences encoding polypeptides referred to in the present application as PRO1358. In particular, cDNA encoding a PRO1358 polypeptide has been identified and isolated, as disclosed in further detail in the Examples below.

Using WU-BLAST2 sequence alignment computer programs, it has been found that a full-length native sequence PRO1358 (shown in FIG. 292 and SEQ ID NO:410) has amino acid sequence identity with RASP-1. Accordingly, it is presently believed that PRO1358 disclosed in the present application is a newly identified member of the serpin family of serine protease inhibitors and may possess serine protease inhibition activity, protein catabolism inhibitory activity and/or be associated with regeneration of tissue.

129. Full-length PRO1195 Polypeptides

The present invention provides newly identified and isolated nucleotide sequences encoding polypeptides referred to in the present application as PRO1195. In particular, cDNA encoding a PRO1195 polypeptide has been identified and isolated, as disclosed in further detail in the Examples below.

Using WU-BLAST2 sequence alignment computer programs, it has been found that a full-length native sequence PRO1195 (shown in FIG. 294 and SEQ ID NO:412) has amino acid sequence identity with MMU28486_1, termed a proline rich acidic protein from *Mus musculus*, locus MMU28486, Accession: U28486, database GBTRANS, submitted 06-JUN-1995 by John W. Kasik. Accordingly, it is presently believed that PRO1195 disclosed in the present application is a newly identified member of this protein family.

130. Full-length PRO1270 Polypeptides

The present invention provides newly identified and isolated nucleotide sequences encoding polypeptides referred to in the present application as PRO1270. In particular, cDNA encoding a PRO1270 polypeptide has been identified and isolated, as disclosed in further detail in the Examples below.

Using the WU-BLAST2 sequence alignment computer program, it has been found that a full-length native sequence PRO1270 (shown in FIG. 296 and SEQ ID NO:414) has amino acid sequence identity with the lectin protein (XLU86699_1) of *Xenopus laevis*. Accordingly, it is presently believed that PRO1270 disclosed in the present application is a newly identified member of the lectin protein family and may possess activity typical of that family.

131. Full-length PRO1271 Polypeptides

The present invention provides newly identified and isolated nucleotide sequences encoding polypeptides referred to in the present application as PRO1271. In particular, cDNA encoding a PRO1271 polypeptide has been identified and isolated, as disclosed in further detail in the Examples below.

As far as is known, the DNA66309-1538 sequence encodes a novel factor designated herein as PRO1271; using WU-BLAST2 sequence alignment computer programs, no significant sequence identities to any known proteins were revealed (results further described in the examples below).

132. Full-length PRO1375 Polypeptides

The present invention provides newly identified and isolated nucleotide sequences encoding polypeptides referred to in the present application as PRO1375. In particular, cDNA encoding a PRO1375 polypeptide has been identified and isolated, as disclosed in further detail in the Examples below.

Using WU-BLAST2 sequence alignment computer programs, it has been found that a full-length native sequence PRO1375 (shown in FIG. 300 and SEQ ID NO:418) has amino acid sequence identity PUT2. Accordingly, it is presently believed that PRO1375 disclosed in the present application has at least one related mechanism of PUT2.

133. Full-length PRO1385 Polypeptides

The present invention provides newly identified and isolated nucleotide sequences encoding polypeptides referred to in the present application as PRO1385. In particular, cDNA encoding a PRO1385 polypeptide has been identified and isolated, as disclosed in further detail in the Examples below.

The DNA68869-1610 clone was isolated from a human tissue library using a trapping technique which selects for nucleotide sequences encoding secreted proteins. Thus, the DNA68869-1610 clone does encode a secreted factor. As far as is known, the DNA68869-1610 sequence encodes a novel factor designated herein as PRO1385; using the WU-BLAST2 sequence alignment computer program, no significant sequence identities to any known proteins were revealed.

134. Full-length PRO1387 Polypeptides

The present invention provides newly identified and isolated nucleotide sequences encoding polypeptides referred to in the present application as PRO1387. In particular, cDNA encoding a PRO1387 polypeptide has been identified and isolated, as disclosed in further detail in the Examples below.

Using the WU-BLAST2 sequence alignment computer program, it has been found that a full-length native sequence PRO1387 (shown in FIG. 304 and SEQ ID NO:422) has amino acid sequence identity with the myelin p0 protein protein precursor (MYP0_HETFR). Accordingly, it is presently believed that PRO1387 disclosed in the present application is a newly identified member of the myelin protein family and may possess activity typical of that family.

135. Full-length PRO1384 Polypeptides

The present invention provides newly identified and isolated nucleotide sequences encoding polypeptides referred to in the present application as PRO1384. In particular, cDNA encoding a PRO1384 polypeptide has been identified and isolated, as disclosed in further detail in the Examples below.

Using WU-BLAST2 sequence alignment computer programs, it has been found that a full-length native sequence PRO1384 (shown in FIG. 306 and SEQ ID NO:424) has amino acid sequence identity with NKG2-D (AF054819_1; Dayhoff database, version 35.45 SwissProt 35). Accordingly, it is presently believed that PRO1384 disclosed in the present application is a newly identified member of the NKG2 family and may possess MHC activation/inactivation activities typical of the NKG2 family.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |

TABLE 6-continued

| Original Residue | Exemplary Substitutions | Preferred Substitutions |
| --- | --- | --- |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:
(1) hydrophobic: norleucine, met, ala, val, leu, ile;
(2) neutral hydrophilic: cys, ser, thr;
(3) acidic: asp, glu;
(4) basic: asn, gin, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081–1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.*, 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W.H. Freeman & Co., San Francisco, pp. 79–86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for 0-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published Sep. 11, 1987, and in Aplin and Wriston, *CRC Crit. Rev. Biochem.*, pp. 259–306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.*, 259:52 (1987) and by Edge et al., *Anal. Biochem.*, 118:131 (1981). Enzymatic cleavage of carbohydrate moieties on polypeptides can be achieved by the use of a variety of endo- and exo-glycosidases as described by Thotakura et al., *Meth. Enzymol.*, 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159–2165 (1988)]; the c-myc tag and the 8F9, 3C7, 6E10, G4, B7 and 9E10 antibodies thereto [Evan et al., *Molecular and Cellular Biology*, 5:3610–3616 (1985)]; and the Herpes Simplex virus glycoprotein D (gD) tag and its antibody [Paborsky et al., *Protein Engineering*, 3(6):547–553 (1990)]. Other tag polypeptides include the Flag-peptide [Hopp et al., *BioTechnology*, 6:1204–1210 (1988)]; the KT3 epitope peptide [Martin et al., *Science*, 255:192–194 (1992)]; an α-tubulin epitope peptide [Skinner et al., *J. Biol. Chem.*, 266:15163–15166 (1991)]; and the T7 gene 10 protein peptide tag [Lutz-Freyermuth et al., *Proc. Natl. Acad. Sci. USA*, 87:6393–6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W.H. Freeman Co., San Francisco, Calif. (1969); Merrifield, *J. Am. Chem. Soc.,* 85:2149–2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a EDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20–80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published Jun. 29, 1989. For mammalian cells without such cell walls, the calcium phosphate precipitation method of Graham and van der Eb, *Virology*, 52:456–457 (1978) can be employed. General aspects of mammalian cell host system transfections have been described in U.S. Pat. No. 4,399,216. Transformations into yeast are typically carried out according to the method of Van Solingen et al., *J. Bact.*, 130:946 (1977) and Hsiao et al., *Proc. Natl. Acad. Sci. (USA)*, 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527–537 (1990) and Mansour et al., *Nature*, 336:348–352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5772 (ATCC 53,635). Other suitable prokaryotic host cells include Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis* (e.g., *B. licheniformis* 41P disclosed in DD 266,710 published Apr. 12, 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3 phoA E15 (argF-lac)169 degP ompT kan'; *E. coli* W3110 strain 37D6, which has the complete genotype tonA ptr3 phoA E15 (argF-lac)169 degP ompT rbs7ilvG kan'; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued Aug. 7, 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharomyces pombe* (Beach and Nurse, *Nature*, 290: 140 [1981]; EP 139,383 published May 2, 1985); *Kluyveromyces* hosts (U.S. Pat. No. 4,943,529; Fleer et al., *Bio/Technology*, 9:968–975 (1991)) such as, e.g., *K. lactis* (MW98-8C, CBS683, CBS4574; Louvencourt et al., *J. Bacteriol.*, 154(2):737–742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology*, 8:135 (1990)), *K. thermotolerans*, and *K. marxianus; yarrowia* (EP 402,226); *Pichia pastoris* (EP 183,070; Sreekrishna et al., *J. Basic Microbiol.*, 28:265–278 [1988]); *Candida; Trichoderma reesia* (EP 244,234); *Neurospora crassa* (Case et al., *Proc. Natl. Acad. Sci. USA*, 76:5259–5263 [1979]); *Schwanniomyces* such as *Schwanniomyces occidentalis* (EP 394,538 published Oct. 31, 1990); and filamentous fungi such as, e.g., *Neurospora, Penicillium, Tolypocladium* (WO 91/00357 published Jan. 10, 1991), and *Aspergillus* hosts such as *A. nidulans* (Ballance et al., *Biochem. Biophys. Res. Commun.*, 112:284–289 [1983]; Tilburn et al., *Gene*, 26:205–221 [1983]; Yelton et al., *Proc. Natl. Acad. Sci. USA*, 81: 1470–1474 [1984]) and *A. niger* (Kelly and Hynes, *EMBO J.*, 4:475–479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, *The Biochemistry of Methylotrophs*, 269 (1982).

Suitable host cells for the expression of glycosylated PRO are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.*, 36:59 (1977)); Chinese hamster ovary cells/-DHFR (CHO, Urlaub and Chasin, *Proc. Natl. Acad. Sci. USA*, 77:4216 (1980)); mouse sertoli cells (TM4, Mather, *Biol. Reprod.*, 23:243–251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010,182), or acid phosphatase leader, the *C. albicans* glucoamylase leader (EP 362,179 published Apr. 4, 1990), or the signal described in WO 90/13646 published Nov. 15, 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2 μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA*, 77:4216 (1980). A suitable selection gene for use in yeast is the trp1 gene present in the yeast plasmid YRp7 [Stinchcomb et al., *Nature*, 282:39 (1979); Kingsman et al., *Gene*, 7:141 (1979); Tschemper et al., *Gene*, 10:157 (1980)]. The trp1 gene provides a selection marker for a mutant strain of yeast lacking the ability to grow in tryptophan, for example, ATCC No. 44076 or PEP4-1 [Jones, *Genetics*, 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature*, 275:615 (1978); Goeddel et al., *Nature*, 281:544 (1979)], alkaline phosphatase, a tryptophan (trp) promoter system [Goeddel, *Nucleic Acids Res.*, 8:4057 (1980); EP 36,776], and hybrid promoters such as the tac promoter [deBoer et al., *Proc. Natl. Acad. Sci. USA*, 80:21–25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., *J. Biol. Chem.*, 255:2073 (1980)] or other glycolytic enzymes [Hess et al., *J. Adv. Enzyme Reg.*, 7:149 (1968); Holland, *Biochemistry*, 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100–270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature*, 293:620–625 (1981); Mantei et al., *Nature*, 281:4046 (1979); EP 117,060; and EP 117,058.

4. Detecting Gene Amplification/Expression

Gene amplification and/or expression may be measured in a sample directly, for example, by conventional Southernblotting, Northernblotting to quantitate the transcriptionof mRNA [Thomas, *Proc. Natl. Acad. Sci. USA*, 77:5201–5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology*, 182 (1990); Scopes, *Protein Purification: Principles and Practice*, Springer-Verlag, New York (1982). The purification step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the full-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidintbiotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $CaPO_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art. Nucleic acids which encode PRO or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, Cell, 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., Cell, 69:915 (1992)]. The selected cells are then injected into a blastocyst of an animal (e.g., a mouse or rat) to form aggregation chimeras [see e.g., Bradley, in Teratocarcinomas and Embryonic Stem Cells: A Practical Approach, E. J. Robertson, ed. (IRL, Oxford, 1987), pp. 113–152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knock-out animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., Proc. Natl. Acad. Sci. USA 83:4143–4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205–210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 44294432 (1987); and Wagner et al., *Proc. Natl. Acad. Sci. USA* 87, 3410–3414 (1990). For review of gene marking and gene therapy protocols see Anderson et al., *Science* 256, 808–813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used for tissue typing, wherein the PRO polypeptides of the present invention may be differentially expressed in one tissue as compared to another. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicolinetics" In Toxicokinetics and New Drug Development, Yacobi et al., Eds., Pergamon Press, New York 1989, pp. 42–96.

When in vivo administration of a PRO polypeptide or agonist or antagonist thereof is employed, normal dosage amounts may vary from about 10 ng/kg to up to 100 mg/kg of mammal body weight or more per day, preferably about 1 $\mu$g/kg/day to 10 mg/kg/day, depending upon the route of administration. Guidance as to particular dosages and methods of delivery is provided in the literature; see, for example, U.S. Pat. Nos. 4,657,760; 5,206,344; or 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.*, 2:795–799 (1996); Yasuda, *Biomed. Ther.*, 27:1221–1223 (1993); Hora et al., *Bio/Technology.* 8:755–758(1990); Cleland, "Design and Production of Single Immunization Vaccines Using Polylactide Polyglycolide Microsphere Systems," in *Vaccine Design: The Subunit and Adjuvant Approach*, Powell and Newman, eds, (Plenum Press: New York, 1995), pp. 439–462; WO 97/03692, WO 96/40072, WO 96/07399; and U.S. Pat. No. 5,654,010.

The sustained-release formulations of these proteins were developed using poly-lactic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1–41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature (London)*, 340:245–246 (1989); Chien et al., *Proc. Natl. Acad. Sci. USA*, 88:9578–9582 (1991)) as disclosed by Chevray and Nathans, *Proc. Natl. Acad. Sci. USA*, 89: 5789–5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKERT™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.*, 6:3073 (1979); Cooney et al., *Science*, 241: 456 (1988); Dervan et al., *Science*, 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.*, 56:560 (1991); *Oligodeox nucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology*, 4:469–471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature*, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature*, 321:522–525 (1986); Riechmann et al., *Nature*, 332:323–329 (1988); and Presta, *Curr. Op. Struct. Biol.*, 2:593–596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature*, 321:522–525 (1986); Riechmann et al., *Nature*, 332:323–327 (1988); Verhoeyen et al., *Science*, 239: 1534–1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.*, 227;381 (1991); Marks et al., *J. Mol. Biol.*, 222:581 (1991)]. The techniques of Cole et al. and Boerner et al. are also available for the preparation of human monoclonal antibodies (Cole et al.,

*Monoclonal Antibodies and Cancer Therapy*, Alan R. Liss, p. 77 (1985) and Boerner et al., *J. Immunol.*, 147(1):86–95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779–783 (1992); Lonberg et al., *Nature* 368 856–859 (1994); Morrison, *Nature* 368, 812–13 (1994); Fishwild et al., *Nature Biotechnology* 14, 845–51 (1996); Neuberger, *Nature Biotechnology* 14, 826 (1996); Lonberg and Huszar, *Intern. Rev. Immunol.* 13 65–93 (1995).

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, *Nature*, 305:537–539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., *EMBO J.*, 10:3655–3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al.,*J. Immunol.* 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994). Antibodies with more than two valencies are contemplated. For example, trispecific antibodies can be prepared. Tutt et al., *J. Immunol.* 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 921200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp. Med.*, 176: 1191–1195(1992) and Shopes, *J. Immunol.*, 148: 2918–2922(1992). Homodineric antibodies with enhanced anti-tumor activity may also be prepared using heterobifunctional cross-linkers as described in Wolff et al. *Cancer Research*, 53: 2560–2565 (1993). Alternatively, an antibody can be engineered that has dual Fc regions and may thereby have enhanced complement lysis and ADCC capabilities. See Stevenson et al., *Anti-Cancer Drug Design*. 3: 219–230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca anzericana* proteins (PAPI, PAPII, and PAP-S), momordica charantia inhibitor, curcin, crotin, sapaonaria *officinalis* inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science*, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed hereinmay also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl Acad. Sci. USA*, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286–288 (1982) via a disulfide-interchange reaction. A chemotherapeutic agent (such as Doxorubicin) is optionally contained within the liposome. See Gabizon et al., *J. National Cancer Inst.*, 81(19):1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA*, 90: 7889–7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytoline, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly- (methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences*, supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly (vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

G. Uses for Anti-PRO Antibodies

The anti-PRO antibodies of the invention have various utilities. For example, anti-PRO antibodies may be used in diagnostic assays for PRO, e.g., detecting its expression in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques*, CRC Press, Inc. (1987) pp. 147–158]. The antibodies used in the diagnostic assays can be labeled with a detectable moiety. The detectable moiety should be capable of producing, either directly or indirectly, a detectable signal. For example, the detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodanine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature*, 144:945 (1962); David et al., *Biochemistry*, 13:1014 (1974); Pain et al., *J. Immunol. Meth.*, 40:219 (1981); and Nygren, *J. Histochem. and Cytochem.*, 30:407 (1982).

Anti-PRO antibodies also are useful for the affinity purification of PRO from recombinant cell culture or natural sources. In this process, the antibodies against PRO are immobilized on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST-2 (Altschul et al., *Methods in Enzymology* 266:460–480 (1996)) as a comparison of the ECD protein sequences to a 6 frame translation of the EST sequences. Those comparisons with a BLAST score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

Example 2

Isolation of cDNA Clones by Amylase Screening

1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI Tinkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary EDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500–1000 bp, Tinkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, MAL$^+$, SUC$^+$, GAL$^+$. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1p-4p) or the complex formation of these proteins may also be preferably employed in combination with the amylase-expressing yeast.

Transformation was performed based on the protocol outlined by Gietz et al., *Nucl. Acid. Res.*, 20:1425 (1992). Transformed cells were then inoculated from agar into YEPD complex media broth (100 ml) and grown overnight at 30° C. The YEPD broth was prepared as described in Kaiser et al., *Methods in Yeast Genetics*, Cold Spring Harbor Press, Cold Spring Harbor, N.Y., p. 207 (1994). The overnight culture was then diluted to about 2×10$^6$ cells/ml (approx. OD$_{600}$=0.1) into fresh YEPD broth (500 ml) and regrown to 1×10$^7$ cells/ml (approx. OD$_{600}$=0.4–0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM Li$_2$OOCCH$_3$), and resuspended into LiAc/TE (2.5 ml).

Transformation took place by mixing the prepared cells (100 μl) with freshly denatured single stranded salmon testes DNA (Lofstrand Labs, Gaithersburg, Md.) and transforming DNA (1 μg, vol. <10 μl) in microfuge tubes. The mixture was mixed briefly by vortexing, then 40% PEG/TE (600 μl, 40% polyethylene glycol-4000, 10 mM Tris-HCl, 1 mM EDTA, 100 mM Li$_2$OOCCH$_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5–10 seconds, decanted and resuspended into TE (500 μl, 10 mM Tris-HCl, 1 mM EDTA pH 7.5) followed by recentrifugation. The cells were then diluted into TE (1 ml) and aliquots (200 μl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics*, Cold Spring Harbor Press, Cold Spring Harbor, N.Y., p. 208–210 (1994). Transformants were grown at 30° C. for 2–3 days.

The detection of colonies secreting amylase was performed by including red starch in the selective growth media. Starch was coupled to the red dye (Reactive Red-120, Sigma) as per the procedure described by Biely et al., *Anal. Biochem.*, 172:176–179 (1988). The coupled starch was incorporated into the SCD-Ura agar plates at a final concentration of 0.15% (w/v), and was buffered with potassium phosphate to a pH of 7.0 (50–100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 μl) in a 96 well plate. At this time, the positive colonies were either frozen and stored for subsequent analysis or immediately amplified. An aliquot of cells (5 μl) was used as a template for the PCR reaction in a 25 μl volume containing: 0.5 μl Klentaq (Clontech, Palo Alto, Calif.); 4.0 μl 10 mM dNTP's (Perldn Elmer-Cetus); 2.5 μl Kentaq buffer (Clontech); 0.25 μl forward oligo 1; 0.25 μl reverse oligo 2; 12.5 μl distilled water. The sequence of the forward oligonucleotide 1 was:

5'-TGTAAAACGACGGCCAGTT<u>AAATAGACCTGCAATTATTAATCT</u>-3' (SEQ ID NO:3)

The sequence of reverse oligonucleotide 2 was:

5'-CAGGAAACAGCTATGACC<u>ACCTGCACACCTGCAAATCCATT</u>-3' (SEQ ID NO:4)

PCR was then performed as follows:

| a. |  | Denature | 92° C., 5 minutes |
|---|---|---|---|
| b. | 3 cycles of: | Denature | 92° C., 30 seconds |
|  |  | Anneal | 59° C., 30 seconds |
|  |  | Extend | 72° C., 60 seconds |
| c. | 3 cycles of: | Denature | 92° C., 30 seconds |
|  |  | Anneal | 57° C., 30 seconds |
|  |  | Extend | 72° C., 60 seconds |
| d. | 25 cycles of: | Denature | 92° C., 30 seconds |
|  |  | Anneal | 55° C., 30 seconds |
|  |  | Extend | 72° C., 60 seconds |
| e. |  | Hold | 4° C. |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 μl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Using Signal Algorithm Analysis

Various polypeptide-encoding nucleic acid sequences were identified by applying a proprietary signal sequence finding algorithm developed by Genentech, Inc. (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

Example 4

Isolation of cDNA Clones Encoding Human PRO281

In order to obtain a cDNA clone encoding PRO281, methods described in Klein et al., Proc. Natl. Acad. Sci. USA 93:7108–7113 (1996) were employed with the following modifications. Yeast transformation was performed with limiting amounts of transforming DNA in order to reduce the number of multiple transformed yeast cells. Instead of plasmid isolation from the yeast followed by transformation of E. coli as described in Klein et al., supra, PCR analysis was performed on single yeast colonies. PCR primers employed were bipartite in order to amplify the insert and a small portion of the invertase gene (allowing to determine that the insert was in frame with invertase) and to add on universal sequencing primer sites.

An invertase library was transformed into yeast and positives were selected on sucrose plates. Positive clones were re-tested and PCR products were sequenced. The sequence of one clone, PRO281, was determined to contain a signal peptide coding sequence. Oligonucleotide primers and probes were designed using the nucleotide sequence of PRO281. A full length plasmid library of cDNAs from human umbilical vein endothelium tissue was titered and approximately 100,000 cfu were plated in 192 pools of 500 cfu/pool into 96-well round bottom plates. The plates were sealed and pools were grown overnight at 37° C. with shaking (200 rpm). PCR was performed on the individual cultures using primers. Agarose gel electrophoresis was performed and positive wells were identified by visualization of a band of the expected size. Individual positive clones were obtained by colony lift followed by hybridization with $^{32}$P-labeled oligonucleotide. These clones were characterized by PCR, restriction digest, and southern blot analyses.

A full length clone was identified that contained a single open reading frame with an apparent translational initiation site at nucleotide positions 80–82, and a stop signal at nucleotide positions 1115–1117 (FIG. 1, SEQ ID NO:1). The predicted polypeptide precursor is 345 amino acids long, has a calculated molecular weight of approximately 37,205 daltons and an estimated pI of approximately 10.15. Analysis of the full-length PRO281 sequence shown in FIG. 2 (SEQ ID NO:2) evidences the presence of the following: a signal peptide from about amino acid 1 to about amino acid 14, multiple transmembrane domains from about amino acid position 83 to about amino acid position 105, from about amino acid position 126 to about amino acid position 146, from about amino acid position 158 to about amino acid position 177, from about amino acid position 197 to about amino acid position 216, from about amino acid position 218 to about amino acid position 238, from about amino acid position 245 to about amino acid position 265, and from about amino acid position 271 to about amino acid position 290 and an amino acid sequence block having homology to G-protein coupled receptor proteins from about amino acid 115 to about amino acid 155. Clone UNQ244 (DNA16422-1209) has been deposited with ATCC on Jun. 2, 1998 and is assigned ATCC deposit no. 209929.

An analysis of the Dayhoff database (version 35.45 SwissProt 35), using a WU-BLAST-2 sequence alignment analysis of the full-length sequence shown in FIG. 2 (SEQ ID NO:2), evidenced significant homology between the PRO281 amino acid sequence and the following Dayhoff sequences: H64634, AF033095_1, B64815, YBHL_ECOLI, EMEQUTR_1, AF064763_3, S53708, A69253, AF035413_12 and S63281.

Example 5

Isolation of cDNA Clones Encoding Human PRO276

In order to obtain a cDNA clone encoding PRO276, methods described in Klein et al., *PNAS*, 93:7108–7113 (1996) were employed with the following modifications. Yeast transformation was performed with limiting amounts of transforming DNA in order to reduce the number of multiple transformed yeast cells. Instead of plasmid isolation from the yeast followed by transformation of *E. coli* as described in Klein et al., supra, PCR analysis was performed on single yeast colonies. PCR primers employed were bipartite in order to amplify the insert and a small portion of the invertase gene (allowing to determine that the insert was in frame with invertase) and to add on universal sequencing primer sites.

An invertase library was transformed into yeast and positives were selected on sucrose plates. Positive clones were re-tested and PCR products were sequenced. The sequence of one clone, PRO276, was determined to contain a signal peptide coding sequence. Oligonucleotide primers and probes were designed using the nucleotide sequence of PRO276. A full length plasmid library of cDNAs from human fetal liver cells was titered and approximately 100,000 cfu were plated in 192 pools of 500 cfu/pool into 96-well round bottom plates. The plates were sealed and pools were grown overnight at 37 C with shaking (200 rpm). PCR was performed on the individual cultures using primers. Agarose gel electrophoresis was performed and positive wells were identified by visualization of a band of the expected size. Individual positive clones were obtained by colony lift followed by hybridization with $^{32}$P-labeled oligonucleotide. These clones were characterized by PCR, restriction digest, and southern blot analyses.

A full length clone was identified that contained a single open reading frame with an apparent translational initiation site at nucleotide positions 180–182 and a stop signal at nucleotide positions 933–935 (FIG. 3; SEQ ID NO:5). The predicted polypeptide precursor is 251 amino acids long has a calculated molecular weight of approximately 28,801 daltons and an estimated pI of approximately 9.58. The transmembrane domains are approximately at amino acids 98–116 and 152–172 of the sequence shown in FIG. 4 (SEQ ID NO:6). Clone DNA16435–1208 (UNQ243) has been deposited with the ATCC and is assigned ATCC deposit no. 209930.

An analysis of the Dayhoff database (version 35.45 SwissProt 35), using a WU-BLAST-2 sequence alignment analysis of the full-length sequence shown in FIG. 4 (SEQ ID NO:6), revealed some sequence identity between the PRO276 amino acid sequence and the following Dayhoff sequences: CEG25D7_2, ATT805_2, S69696, GRHR_RAT, NPCBAABCD_3, AB013149_1, P_R85942 and AP000006_5.

Example 6

Isolation of cDNA Clones Encoding Human PRO189

A clone designated herein as DNA14187 was isolated as described in Example 2 above from a human retina tissue library. The DNA14187 sequence is shown in FIG. 7 (SEQ ID NO:9). Based on the DNA14187 sequence shown in FIG. 7 (SEQ ID NO:9), oligonucleotides were synthesized: 1) to identify by PCR a cDNA library that contained the sequence of interest, and 2) for use as probes to isolate a clone of the full-length coding sequence for PRO189. Forward and reverse PCR primers generally range from 20 to 30 nucleotides and are often designed to give a PCR product of about 100–1000 bp in length. The probe sequences are typically 40–55 bp in length. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

A pair of PCR primers (forward and reverse) were synthesized:

```
forward PCR primer  5'-TTGACCTATACAGAGATTCATC-3'  (SEQ ID NO:10); and
reverse PCR primer  5'-CTAAGAACTTCCCTCAGGATTTT-3' (SEQ ID NO:11).
```

Additionally, a synthetic oligonucleotide hybridization probe was constructed from the DNA14187 sequence which had the following nucleotide sequence:
Hybridization Probe
5'-ATGAAGATCAATTTCAAGAAGCATGCACTTCTC
CTCTTGC-3' (SEQ ID NO:12).

In order to screen several libraries for a source of a full-length clone, DNA from the libraries was screened by PCR amplification with the PCR primer pair identified above. A positive library was then used to isolate clones encoding the PRO189 gene using the probe oligonucleotide and one of the PCR primers.

RNA for construction of the cDNA libraries was isolated from human retina tissue (LIB94). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for PRO189 and the derived protein sequence for PRO189.

The entire nucleotide sequence of DNA21624-1391 is shown in FIG. 5 (SEQ ID NO:7). Clone DNA21624-1391 contains a single open reading frame with an apparent translational initiation site at nucleotide positions 200–202 and ending at the stop codon at nucleotide positions 1301–1303 (FIG. 5). The predicted polypeptide precursor is 367 amino acids long (FIG. 6). The full-length PRO189 protein shown in FIG. 6 has an estimated molecular weight of about 41,871 daltons and a pI of about 5.06. Clone DNA21624-1391 has been deposited with the ATCC. Regarding the sequence, it is understood that the deposited clone contains the correct sequence, and the sequences provided herein are based on known sequencing techniques.

Analyzing the amino acid sequence of SEQ ID NO:8, the putative N-glycosylation sites are at about amino acids 224–227, 246–249 and 285–288. A domain for cytosolic fatty-acid binding proteins is at amino acids 78–107 of SEQ ID NO:8. The corresponding nucleotides can be routinely determined given the sequences provided herein.

Some sequence identity was found to WO1A6.1 and F35D11.11, *C. Elegans* proteins, designated in a Dayhoff database as CEW01A6__10 and CELF35D11__1, respectively. Some sequence identity was also found to an antigen to malaria and to restin, designated in a Dayhoff database as P__R05766 and AF014012__1, respectively. Some sequence identity was also found to a microtubule binding protein and to myosin, designated in a Dayhoff database as AF041382__1 and S07537, respectively. There is also some sequence identity with 1-phosphatidylinositol-4,5-bisphosphate, designated as PIP1__RAT.

Example 7

Isolation of cDNA Clones Encoding Human PRO190

A clone designated herein as DNA14232 was isolated as described in Example 2 above from a human fetal retina tissue library. The DNA14232 sequence is shown in FIG. 10 (SEQ ID NO:15). Based on the DNA14232 sequence, oligonucleotides were synthesized: 1) to identify by PCR a cDNA library that contained the sequence of interest, and 2) for use as probes to isolate a clone of the full-length coding sequence for PRO190. Forward and reverse PCR primers generally range from 20 to 30 nucleotides and are often designed to give a PCR product of about 100–1000 bp in length. The probe sequences are typically 40–55 bp in length. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

A pair of PCR primers (forward and reverse) were synthesized:

forward PCR primer 5'-CTATACCTACTGTAGCTTCT-3' (SEQ ID NO:16); and reverse PCR primer 5'-TCAGAGAATTCCTTCCAGGA-3' (SEQ ID NO:17).

Additionally, a synthetic oligonucleotide hybridization probe was constructed from the DNA14232 sequence which had the following nucleotide sequence:
Hybridization Probe
5'-ACAGTGCTGTAGTCATCCTGTAATATGCTCCTT GTCAACA-3' (SEQ ID NO:18).

In order to screen several libraries for a source of a full-length clone, DNA from the libraries was screened by PCR amplification with the PCR primer pair identified above. A positive library was then used to isolate clones encoding the PRO190 gene using the probe oligonucleotide and one of the PCR primers.

RNA for construction of the cDNA libraries was isolated from human retina tissue (LIB94). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRKSB is a precursor of pRK5D that does not contain the SfiI site; see, Holmes et al., *Science*, 253:1278–1280 (1991)) in the unique XhoI and NotI sites.

DNA sequencing of the clones isolated as described above gave sequences which include the full-length DNA sequence for PRO190 [herein designated as DNA23334-1392] (SEQ ID NO:13) and the derived protein sequence for PRO190.

The entire nucleotide sequence of DNA23334-1392 is shown in FIG. 8 (SEQ ID NO:13). Clone DNA23334-1392 contains a single open reading frame with an apparent translational initiation site at nucleotide positions 193–195 and which ends at the stop codon at nucleotide positions 1465–1467 (FIG. 8). The predicted polypeptide precursor is 424 amino acids long (FIG. 9). The full-length PRO190 protein shown in FIG. 9 has an estimated molecular weight of about 48,500 daltons and a pI of about 8.65. Clone DNA23334-1392 has been deposited with the ATCC. Regarding the sequence, it is understood that the deposited clone contains the correct sequence, and the sequences provided herein are based on known sequencing techniques.

Analyzing the amino acid sequence of SEQ ID NO:14, the putative transmembrane domains are at about amino acids 16–36, 50–74, 147–168, 229–250, 271–293, 298–318 and 328–368 of SEQ ID NO:14. N-glycosylation sites are at about amino acids 128–131, 204–207, 218–221 and 274–377 of SEQ ID NO:14. The corresponding nucleotides can be routinely determined given the sequences provided herein.

PRO190 has sequence identity with at least the following Dayhoff sequences designated as: CEZK896__2, JC5023, GMS1__SCHPO and S44668.

Example 8

Isolation of cDNA Clones Encoding Human PRO341

A clone designated herein as DNA12920 was isolated as described in Example 2 above from a human placenta tissue library. The DNA12920 sequence is shown in FIG. 13 (SEQ ID NO:21). The DNA12920 sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., Methods in Enzymology, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence is herein designated DNA25314. Oligonucleotide primers based upon the DNA25314 sequence were then synthesized and employed to screen a human placenta cDNA library which resulted in the identification of the DNA26288-1239 clone shown in FIG. 11. The cloning vector was pRK5B (pRK5B is a precursor of pRK5D that does not contain the SfiI site; see, Holmes et al., Science, 253:1278–1280 (1991)), and the cDNA size cut was less than 2800 bp.

A full length clone was identified that contained a single open reading frame with an apparent translational initiation site at nucleotide positions 380–382, and a stop signal at nucleotide positions 1754–1756 (FIG. 11, SEQ ID NO:19). The predicted polypeptide precursor is 458 amino acids long, has a calculated molecular weight of approximately 50,264 daltons and an estimated pI of approximately 8.17. Analysis of the full-length PRO341 sequence shown in FIG. 12 (SEQ ID NO:20) evidences the presence of the following: a signal peptide from about amino acid 1 to about amino acid 17, transmembrane domains from about amino acid 171 to about amino acid 190, from about amino acid 220 to about amino acid 239, from about amino acid 259 to about amino acid 275, from about amino acid 286 to about amino acid 305, from about amino acid 316 to about amino acid 335, from about amino acid 353 to about amino acid 378 and from about amino acid 396 to about amino acid 417 and potential N-glycosylation sites from about amino acid 145 to about amino acid 147 and from about amino acid 155 to about amino acid 158. Clone DNA26288-1239 has been deposited with ATCC on Apr. 21, 1998 and is assigned ATCC deposit no. 209792.

An analysis of the Dayhoff database (version 35.45 Swis-sProt 35), using a WU-BLAST-2 sequence alignment analysis of the full-length sequence shown in FIG. 12 (SEQ ID NO:20), evidenced homology between the PRO341 amino acid sequence and the following Dayhoff sequences: S75696, H69788, D69852, A69888, B64918, F64752, LPU89276_1, G64962, S52977 and S44253.

Example 9

Isolation of cDNA Clones Encoding Human PRO180

A clone designated herein as DNA12922 was isolated as described in Example 2 above from a human placenta tissue library. The DNA12922 sequence is shown in FIG. 16 (SEQ ID NO:24). The DNA12922 sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., Methods in Enzymology, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.).

An oligonucleotide probe was formed based upon the consensus sequence obtained above. This probe had the following sequence.
5'-ACCTGTTAGAAATGTGGTGGTTTCAGCAAGGC CTCAGTTT (SEQ ID NO:25).
This probe was used to screen a human placenta library prepared as described in paragraph 1 of Example 2 above. The cloning vector was pRK5B (pRK5B is a precursor of pRK5D that does not contain the SfiI site; see, Holmes et al., Science, 253: 1278–1280 (1991)), and the cDNA size cut was less than 2800 bp. A clone designated herein as DNA26843-1389 was obtained.

The entire nucleotide sequence of DNA26843-1389 is shown in FIG. 14 (SEQ ID NO:22). Clone DNA26843-1389 contains a single open reading frame with an apparent translational initiation site at nucleotide positions 121–123 and ending at the stop codon at nucleotide positions 919–921 (FIG. 14). The predicted polypeptide precursor is 266 amino acids long (FIG. 15). The full-length PRO180 protein shown in FIG. 15 has an estimated molecular weight of about 29,766 daltons and a pI of about 8.39. Clone DNA26843-1389 has been deposited with the ATCC. Regarding the sequence, it is understood that the deposited clone contains the correct sequence, and the sequences provided herein are based on known sequencing techniques.

Still analyzing the amino acid sequence of SEQ ID NO:23, the transmembrane domains are at about amino acids 13–33 (type II), 54–73, 94–113, 160–180 and 122–141 of SEQ ID NO:23. N-myristoylation sites are at about amino acids 57–62, 95–100, 99–104, 124–129 and 183–188 of SEQ ID NO:23. The corresponding nucleotides can be routinely determined given the sequences provided herein.

An analysis of the Dayhoff database (version 35.45 Swis-sProt 35), using a WU-BLAST2 sequence alignment analysis of the full-length sequence shown in FIG. 15 (SEQ ID NO:23), evidenced some sequence identity between the PRO180 amino acid sequence and the following Dayhoff sequences: CEC33A11_2, CEG11E6_5, CELW03A5_1 AND PEU83861_2 (NADH dehydrogenase subunit 4L, mitochondrion).

Example 10

Isolation of cDNA Clones Encoding Human PRO194

A consensus DNA sequence was assembled relative to other EST sequences using phrap as described in Example 1 above. This consensus sequence is herein DNA19464. Based on the DNA19464 consensus sequence, oligonucleotides were synthesized: 1) to identify by PCR a cDNA library that contained the sequence of interest, and 2) for use as probes to isolate a clone of the full-length coding sequence for PRO194. PCR primers (forward and reverse) were synthesized based upon the DNA19464 sequence. Additionally, a synthetic oligonucleotide hybridization probe was constructed from the consensus DNA19464 sequence.

In order to screen several libraries for a source of a full-length clone, DNA from the libraries was screened by PCR amplification with the PCR primer pair identified above. A positive library was then used to isolate clones encoding the PRO194 gene using the probe oligonucleotide and one of the PCR primers. RNA for construction of the cDNA libraries was isolated from human fetal lung tissue (LIB25).

DNA sequencing of the clones isolated as described above gave the full-length DNA sequence for PRO194 [herein designated as DNA26844-1394] (SEQ ID NO:27) and the derived protein sequence for PRO194.

The entire nucleotide sequence of DNA26844-1394 is shown in FIG. 17 (SEQ ID NO:27). Clone DNA26844-1394 contains a single open reading frame with an apparent translational initiation site at nucleotide positions 81–83 and ending at the stop codon at nucleotide positions 873–875 (FIG. 17). The predicted polypeptide precursor is 264 amino acids long (FIG. 18). The full-length PRO194 protein shown in FIG. 18 has an estimated molecular weight of about 29,665 daltons and a pI of about 9.34. Analysis of the full-length PRO194 sequence shown in FIG. 18 (SEQ ID NO:28) evidences the presence of various important polypeptides domains as shown in FIG. 18. Clone DNA26844-1394 has been deposited with ATCC on Jun. 2, 1998 and is assigned ATCC deposit no. 209926.

Analysis of the amino acid sequence of the full-length PRO194 polypeptide suggests that it does not exhibit significant sequence similarity to any known human protein. However, an analysis of the Dayhoff database (version 35.45 SwissProt 35) evidenced some homology between the PRO194 amino acid sequence and the following Dayhoff sequences, HUMORFT_1, CET07F10_5, ATFCA9_12, F64934, YDJX_ECOLI, ATAF00065719F29G20.19, H70002, S76980, H64934 and S76385.

Example 11

Isolation of cDNA Clones Encoding Human PRO203

A clone designated herein as DNA15618 was isolated as described in Example 2 above from a human fetal lung tissue library. The DNA15618 sequence is shown in FIG. 21 (SEQ ID NO:31). Oligonucleotide probes were generated from the sequence of the DNA15618 molecule and were used to screen a human fetal lung library (LIB26) prepared as described in paragraph 1 of Example 2 above. The cloning vector was pRK5B (pRK5B is a precursor of pRK5D that does not contain the SfiI site; see, Holmes et al., *Science*, 253:1278–1280 (1991)), and the cDNA size cut was less than 2800 bp.

A full length clone was identified that contained a single open reading frame with an apparent translational initiation site at nucleotide positions 159–161 and ending at the stop codon found at nucleotide positions 1200–1202 (FIG. 19; SEQ ID NO:29). The predicted polypeptide precursor is 347 amino acids long, has a calculated molecular weight of approximately 39,870 daltons and an estimated pI of approximately 6.76. Analysis of the full-length PRO203 sequence shown in FIG. 20 (SEQ ID NO:30) evidences the presence of the following: a type II transmembrane domain at about amino acid 64 to about amino acid 87; possible N-glycosylation sites at about amino acid 147 to about amino acid 150, about amino acid 155 to about amino acid 158, and about amino acid 237 to about amino acid 240; sequence identity with heavy-metal-associated domain proteins at about amino acid 23 to about amino acid 45, and sequence identity with D-isomer specific 2-hydroxyacid dehydrogenase at about amino acid 24 to about amino acid 34. Clone DNA30862-1396 was deposited with the ATCC on Jun. 2, 1998, and is assigned ATCC deposit no. 209920.

Analysis of the amino acid sequence of the full-length PRO203 polypeptide suggests that it possesses sequence similarity to GST ATPase, thereby indicating that PRO203 may be a novel GST ATPase. More specifically, an analysis of the Dayhoff database (version 35.45 SwissProt 35) evidenced homology between the PRO203 amino acid sequence and the following Dayhoff sequences, AF008124_1, CFRCD1GEN_1, and P_R82566.

Example 12

Isolation of cDNA Clones Encoding Human PRO290

An expressed sequence tag (EST) DNA database (LIFESEQ®, Incyte Pharmaceuticals, Palo Alto, Calif.) was searched and an EST was identified that had homology to beige and FAN. An oligonucleotide probe based upon the identified EST sequence was then synthesized and used to screen human fetal kidney cDNA libraries in an attempt to identify a full-length cDNA clone. The oligonucleotide probe had the following sequence:

5' TGACTGCACTACCCCGTGGCAAGCTGT-TGAGCCAGCTCAGCTG 3' (SEQ ID NO:34).

RNA for construction of cDNA libraries was isolated from human fetal kidney tissue. The cDNA libraries used to isolate the cDNA clones encoding human PRO290 were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science* 253:1278–1280 (1991)) in the unique XhoI and NotI.

A cDNA clone was identified and sequenced in entirety. The entire nucleotide sequence of DNA35680-1212 is shown in FIG. 22 (SEQ ID NO:32). Clone DNA35680-1212 contains a single open reading frame with an apparent translational initiation site at nucleotide positions 293–295, and a stop codon at nucleotide positions 3302–3304 (FIG. 22; SEQ ID NO:32). The predicted polypeptide precursor is 1003 amino acids long.

It is currently believed that the PRO290 polypeptide is related to FAN and/or beige. Clone DNA35680-1212 has been deposited with ATCC and is assigned ATCC deposit no. 209790. It is understood that the deposited clone has the actual correct sequence rather than the representations provided herein. The full-length PRO290 protein shown in FIG. 23 has an estimated molecular weight of about 112,013 daltons and a pI of about 6.4.

Example 13

Isolation of cDNA Clones Encoding Human PRO874

A consensus DNA sequence designated herein as DNA36459 was identified using phrap as described in Example 1 above. Based on the DNA36459 consensus sequence, oligonucleotides were synthesized: 1) to identify by PCR a cDNA library that contained the sequence of interest, and 2) for use as probes to isolate a clone of the coding sequence for PRO874.

PCR primers (forward and reverse) were synthesized:

```
forward PCR primer   5'-TCGTGCCCAGGGGCTGATGTGC-3'    (SEQ ID NO:37); and reverse PCR primer   5'-GTCTTTACCCAGCCCCGGGATGCG-3'  (SEQ ID NO:38).
```

Additionally, a synthetic oligonucleotide hybridization probe was constructed from the consensus DNA36459 sequence which had the following nucleotide sequence:
Hybridization Probe
5'-GGCCTAATCCAACGTTCTGTCTTCAATCTGCAA ATCTATGGGGTCCTGGG-3' (SEQ ID NO:39).

In order to screen several libraries for a source of a clone, DNA from the libraries was screened by PCR amplification with the PCR primer pair identified above. A positive library was then used to isolate clones encoding the PRO874 gene using the probe oligonucleotide and one of the PCR primers.

library that contained the sequence of interest, and 2) for use as probes to isolate a clone of the full-length coding sequence for PRO710. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

PCR primers (forward and reverse) were synthesized:

```
forward PCR primer   5'-TTCCGCAAAGAGTTCTACGAGGTGG-3'   (SEQ ID NO:43)

reverse PCR primer   5'-ATTGACAACATTGACTGGCCTATGGG-3'  (SEQ ID NO:44)
```

RNA for construction of the cDNA libraries was isolated from human fetal lung tissue (LIB25).

DNA sequencing of the clones isolated as described above gave the DNA sequence for PRO874 [herein designated as DNA40621-1440] (SEQ ID NO:35) and the derived protein sequence for PRO874.

The entire nucleotide sequence of DNA40621-1440 is shown in FIG. 24 (SEQ ID NO:35). Clone DNA40621-1440 contains a single open reading frame ending at the stop codon at nucleotide positions 964–966 (FIG. 24). The predicted polypeptide encoded by DNA40621-1440 is 321 amino acids long (FIG. 25). The PRO874 protein shown in FIG. 25 has an estimated molecular weight of about 36,194 daltons and a pI of about 9.85. Analysis of the PRO874 sequence shown in FIG. 25 (SEQ ID NO:36) evidenced the presence of the following: a type II transmembrane domain at about amino acids 57–80; additional transmembrane domains at about amino acids 110–126, 215–231, and 254–274; potential N-glycosylation sites at about amino acids 16–19, 27–30, and 289–292; sequence identity with hypothetical YBR102c family proteins at about amino acids 276–287; and sequence identity with ammonium transporter proteins at about amino acids 204–230. Clone DNA40621-1440 was deposited with the ATCC on Jun. 2, 1998, and is assigned ATCC deposit no. 209922.

Analysis of the amino acid sequence of the PRO874 polypeptide suggests that it is a novel multi-span transmembrane protein. However, an analysis of the Dayhoff database (version 35.45 SwissProt 35) evidenced sequence identity between the PRO874 amino acid sequence and the following Dayhoff sequences: S67049, AF054839_1, S73437, S52460, and HIVU80570_1.

Example 14

Isolation of cDNA Clones Encoding Human PRO710

A yeast screening assay was employed to identify cDNA clones that encoded potential secreted proteins. Use of this yeast screening assay allowed identification of a single cDNA clone whose sequence (herein designated as DNA38190) is shown in FIG. 28 (SEQ ID NO:42). Based on the DNA38190 sequence shown in FIG. 28, oligonucleotides were synthesized: 1) to identify by PCR a cDNA Additionally, a synthetic oligonucleotide hybridization probe was constructed from the DNA38190 sequence which had the following nucleotide sequence
Hybridization Probe
5'-GTGGATGCTCTGTGTGCGTGCAAGATCCTTCAG GCCTTGTTCCAGTGTGA-3' (SEQ ID NO:45)

In order to screen several libraries for a source of a full-length clone, DNA from the libraries was screened by PCR amplification with the PCR primer pair identified above. A positive library was then used to isolate clones encoding the PRO710 gene using the probe oligonucleotide and one of the PCR primers.

RNA for construction of the cDNA libraries was isolated from human fetal kidney tissue (LIB227). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

A full length clone was identified that contained a single open reading frame with an apparent translational initiation site at nucleotide positions 67–69 and ending at the stop codon found at nucleotide positions 1765–1767 (FIG. 26, SEQ ID NO:40). The predicted polypeptide precursor is 566 amino acids long, has a calculated molecular weight of approximately 65,555 daltons and an estimated pI of approximately 5.44. Analysis of the full-length PRO710 sequence shown in FIG. 27 (SEQ ID NO:41) evidences the presence of the following: a signal peptide from about amino acid 1 to about amino acid 32, a transmembrane domain from about amino acid 454 to about amino acid 476, an aminoacyl-transfer RNA synthetase class-II signature sequence from about amino acid 6 to about amino acid 26 and potential N-glycosylation sites from about amino acid 111 to about amino acid 114, from about amino acid 146 to about amino acid 149 and from about amino acid 292 to about amino acid 295. Clone DNA44161-1434 has been deposited with ATCC on May 27, 1998 and is assigned ATCC deposit no. 209907.

Analysis of the amino acid sequence of the full-length PRO710 polypeptide suggests that it possesses significant sequence similarity to the CDC45 protein, thereby indicating that PRO710 may be a novel CDC45 homolog. More specifically, an analysis of the Dayhoff database (version 35.45 SwissProt 35) evidenced significant homology between the PRO710 amino acid sequence and the following Dayhoff sequences, HSAJ3728_1, CEF34D10_1, S64939, UMU50276_1, TRHY_SHEEP, CELT14E8_1, RNA1_YEAST, LVU89340_1, HSU80736_1 and CEZK337_2.

Example 15

Isolation of cDNA Clones Encoding Human PRO1151

A consensus DNA sequence was assembled relative to other EST sequences using phrap as described in Example 1 above. This consensus sequence is herein designated DNA40665. Based on the DNA40665 consensus sequence, oligonucleotides were synthesized: 1) to identify by PCR a cDNA library that contained the sequence of interest, and 2) for use as probes to isolate a clone of the full-length coding sequence for PRO1151.

PCR primers (forward and reverse) were synthesized:

```
forward PCR primer  5'-CCAGACGCTGCTCTTCGAAAGGGTC-3'  (SEQ ID NO:48)

reverse PCR primer  5'-GGTCCCCGTAGGCCAGGTCCAGC-3'   (SEQ ID NO:49)
```

Additionally, a synthetic oligonucleotide hybridization probe was constructed from the consensus DNA40665 sequence which had the following nucleotide sequence
Hybridization Probe
5'-CTACTTCTTCAGCCTCAATGTGCACAGCTGGA ATTACAAGGAGACGTACG-3' (SEQ ID NO:50)

In order to screen several libraries for a source of a full-length clone, DNA from the libraries was screened by PCR amplification with the PCR primer pair identified above. A positive library was then used to isolate clones encoding the PRO1151 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1151 (designated herein as DNA44694-1500 [FIG. 29, SEQ ID NO:46]; and the derived protein sequence for PRO1151.

The entire nucleotide sequence of DNA44694-1500 is shown in FIG. 29 (SEQ ID NO:46). Clone DNA44694-1500 contains a single open reading frame with an apparent translational initiation site at nucleotide positions 272–274 and ending at the stop codon at nucleotide positions 1049–1051 (FIG. 29). The predicted polypeptide precursor is 259 amino acids long (FIG. 30). The full-length PRO1151 protein shown in FIG. 30 has an estimated molecular weight of about 28,770 daltons and a pI of about 6.12. Analysis of the full-length PRO1151 sequence shown in FIG. 30 (SEQ ID NO:47) evidences the presence of the following: a signal peptide from about amino acid 1 to about amino acid 20, a potential N-glycosylation site from about amino acid 72 to about amino acid 75 and amino acid sequence blocks having homology to C1q domain-containing proteins from about amino acid 144 to about amino acid 178, from about amino acid 78 to about amino acid 111 and from about amino acid 84 to about amino acid 117. Clone UNQ581 (DNA44694-1500) has been deposited with ATCC on Aug. 11, 1998 and is assigned ATCC deposit no. 203114.

An analysis of the Dayhoff database (version 35.45 SwissProt 35), using a WU-BLAST-2 sequence alignment analysis of the full-length sequence shown in FIG. 30 (SEQ ID NO:47), evidenced significant homology between the PRO1151 amino acid sequence and the following Dayhoff sequences: ACR3_HUMAN, HP25_TAMAS, HUMC1QB2_1, P_R99306, CA1F_HUMAN, JX0369, CA24_HUMAN, S32436, P_R28916 and CA54_HUMAN.

Example 16

Isolation of cDNA Clones Encoding Human PRO1282

A consensus DNA sequence was assembled relative to other EST sequences using phrap as described in Example 1 above. This consensus sequence is designated herein as DNA33778. Based on the DNA33778 consensus sequence, oligonucleotides were synthesized: 1) to identify by PCR a cDNA library that contained the sequence of interest, and 2) for use as probes to isolate a clone of the full-length coding sequence for PRO1282.

PCR primers (forward and reverse) were synthesized:

```
forward PCR primer  5'TCTTCAGCCGCTTGCGCAACCTC3'  (SEQ ID NO:53); and reverse PCR primer  5'TTGCTCACATCCAGCTCCTGCAGG3'  (SEQ ID NO:54).
```

Additionally, a synthetic oligonucleotide hybridization probe was constructed from the consensus DNA33778 sequence which had the following nucleotide sequence:
Hybridization Probe
5'TGGATGTTGTCCAGACAACCAGCTG-GAGCTGTATCCGAGGC3' (SEQ ID NO:55).

In order to screen several libraries for a source of a full-length clone, DNA from the libraries was screened by PCR amplification with the PCR primer pair identified above. A positive library was then used to isolate clones encoding the PRO1282 gene using the probe oligonucleotide and one of the PCR primers. RNA for construction of the cDNA libraries was isolated from human fetal liver.

DNA sequencing of the clones isolated as described above gave the full-length DNA sequence for PRO1282 (designated herein as DNA45495-1550 [FIG. 31, SEQ ID NO:51]; and the derived protein sequence for PRO1282.

The entire coding sequence of PRO1282 is shown in FIG. 31 (SEQ ID NO:51). Clone DNA45495-1550 contains a single open reading frame with an apparent translational initiation site at nucleotide positions 120–122, and an apparent stop codon at nucleotide positions 2139–2141 (SEQ ID NO:51). The predicted polypeptide precursor is 673 amino acids long. The signal peptide is at about amino acids 1–23;

the transmembrane domain is at about amino acids 579–599; an EGF-like domain cysteine pattern signature starts at about amino acid 430; and leucine zipper patterns start at about amino acids 197 and 269 of SEQ ID NO:52, see FIG. 32. Clone DNA45495-1550 has been deposited with the ATCC and is assigned ATCC deposit no. 203156. The full-length PRO1282 protein shown in FIG. 32 has an estimated molecular weight of about 71,655 daltons and a pI of about 7.8.

An analysis of the Dayhoff database (version 35.45 SwissProt 35), using a WU-BLAST-2 sequence alignment analysis of the full-length sequence shown in FIG. 32 (SEQ ID NO:52), revealed sequence identity between the PRO1282 amino acid sequence and the following Dayhoff sequences (data from database incorporated by reference): AB007876_1, RNPLGPV_1, MUSLRRP_1, ALS_PAPPA, AC004142_1, ALS_HUMAN, AB014462_1, DMTARTAN_1, HSCHON03_1 and S46224.

Example 17

Isolation of cDNA Clones Encoding Human PRO358

Using the method described in Example 1 above, a single EST sequence was identified in the Incyte database, designated herein as INC3115949. Based on the INC3115949 EST sequence, oligonucleotides were synthesized to identify by PCR a cDNA library that contained the sequence of interest and for use as probes to isolate a clone of the full-length coding sequence for PRO358.

A pair of PCR primers (forward and reverse) were synthesized:

```
forward PCR primer   5'-TCCCACCAGGTATCATAAACTGAA-3'    (SEQ ID NO:58)
reverse PCR primer   5'-TTATAGACAATCTGTTCTCATCAGAGA-3' (SEQ ID NO:59)
```

A Probe was also Synthesized:
5'-AAAAAGCATACTTGGAATGGCCCAAGGATAGG TGTAAATG-3' (SEQ ID NO:60)

In order to screen several libraries for a source of a full-length clone, DNA from the libraries was screened by PCR amplification with the PCR primer pair identified above. A positive library was then used to isolate clones encoding the PRO358 gene using the probe oligonucleotide and one of the PCR primers. RNA for construction of the cDNA libraries was isolated from human bone marrow (LIB256). The cDNA libraries used to isolated the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for PRO358 (FIG. 33, SEQ ID NO:56) and the derived protein sequence for PRO358 (FIG. 34, SEQ ID NO:57).

The entire nucleotide sequence of the clone identified (DNA47361-1154) is shown in FIG. 33 (SEQ ID NO:56). Clone DNA47361-1154 contains a single open reading frame with an apparent translational initiation site (ATG start signal) at nucleotide positions underlined in FIG. 33. The predicted polypeptide precursor is 811 amino acids long, including a putative signal sequence (amino acids 1 to 19), an extracellular domain (amino acids 20 to 575, including leucine rich repeats in the region from position 55 to position 575), a putative transmembrane domain (amino acids 576 to 595). Clone DNA47361-1249 has been deposited with ATCC and is assigned ATCC deposit no. 209431.

Example 18

Isolation of cDNA Clones Encoding Human PRO1310

A consensus DNA sequence was assembled relative to other EST sequences using phrap as described in Example 1 above. This consensus sequence is designated herein as DNA37164. Based on the DNA37164 consensus sequence, oligonucleotides were synthesized: 1) to identify by PCR a cDNA library that contained the sequence of interest, and 2) for use as probes to isolate a clone of the full-length coding sequence for PRO1310.

PCR primers (forward and reverse) were synthesized:

```
forward PCR primer: 5'GTTCTCAATGAGCTACCCGTCCCC3'  (SEQ ID NO:63) and
reverse PCR primer: 5'CGCGATGTAGTGGAACTCGGGCTC3'  (SEQ ID NO:64).
```

Additionally, a synthetic oligonucleotide hybridization probe was constructed from the consensus DNA47394 sequence which had the following nucleotide sequence:
Hybridization Probe:
5'ATCCGCATAAACCCTCAGTCCTG-GTTTGATAATGGGAGCATCTGCATGAG3' (SEQ ID NO:65).

In order to screen several libraries for a source of a full-length clone, DNA from the libraries was screened by PCR amplification with the PCR primer pair identified above. A positive library was then used to isolate clones encoding the PRO1310 gene using the probe oligonucleotide and one of the PCR primers. RNA for construction of the cDNA libraries was isolated from human fetal liver tissue.

DNA sequencing of the clones isolated as described above gave the full-length DNA sequence for PRO1310 and the derived protein sequence for PRO1310.

The entire coding sequence of PRO1310 is shown in FIG. 35 (SEQ ID NO:61). Clone DNA47394-1572 contains a single open reading frame with an apparent translational initiation site at nucleotide positions 326–328, and an apparent stop codon at nucleotide positions 2594–2596 (SEQ ID NO:61). The predicted polypeptide precursor is 765 amino acids long. The signal peptide is at about amino acids 1–25 of SEQ ID NO:62. Clone DNA47394-1572 has been deposited with ATCC and is assigned ATCC deposit no. 203109. The full-length PRO1310 protein shown in FIG. 36 has an estimated molecular weight of about 85,898 daltons and a pI of about 6.87.

An analysis of the Dayhoff database (version 35.45 SwissProt 35), using a WU-BLAST-2 sequence alignment analysis of the full-length sequence shown in FIG. 36 (SEQ ID NO:62), revealed sequence identity between the PRO1310 amino acid sequence and the following Dayhoff sequences: AF017639_1, P_W36817, JC5256, CBPH_HUMAN, MMU23184_1, CBPN_HUMAN, HSU83411_1, CEF01D4_7, RNU62897_1 and P_W11851.

Example 19

Isolation of cDNA Clones Encoding Human PRO698

A yeast screening assay was employed to identify cDNA clones that encoded potential secreted proteins. Use of this yeast screening assay allowed identification of a single cDNA clone whose sequence (herein designated as DNA39906) is shown in FIG. 39 (SEQ ID NO:68). Based on the DNA39906 sequence shown in FIG. 39, oligonucleotides were synthesized: 1) to identify by PCR a cDNA library that contained the sequence of interest, and 2) for use as probes to isolate a clone of the full-length coding sequence for PRO698. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

PCR primers (forward and reverse) were synthesized:

tation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

A full length clone was identified that contained a single open reading frame with an apparent translational initiation site at nucleotide positions 14–16 and ending at the stop codon found at nucleotide positions 1544–1546 (FIG. 37, SEQ ID NO:66). The predicted polypeptide precursor is 510 amino acids long, has a calculated molecular weight of approximately 57,280 daltons and an estimated pI of approximately 5.61. Analysis of the full-length PRO698 sequence shown in FIG. 38 (SEQ ID NO:67) evidences the presence of the following: a signal peptide from about amino acid 1 to about amino acid 20, potential N-glycosylation sites from about amino acid 72 to about amino acid 75, from about amino acid 136 to about amino acid 139, from about amino acid 193 to about amino acid 196, from about amino acid 253 to about amino acid 256, from about amino acid 352 to about amino acid 355 and from about amino acid 411 to about amino acid 414 an amino acid block having homology to legume lectin beta-chain proteins from about amino acid 20 to about amino acid 39 and an amino acid block having homology to the HBGF/FGF family of proteins from about amino acid 338 to about amino acid 365. Clone DNA48320-1433 has been deposited with ATCC on May 27, 1998 and is assigned ATCC deposit no. 209904.

Analysis of the amino acid sequence of the full-length PRO698 polypeptide suggests that it possesses significant sequence similarity to the olfactomedin protein, thereby indicating that PRO698 may be a novel olfactomedin homolog. More specifically, an analysis of the Dayhoff database (version 35.45 SwissProt 35) evidenced significant homology between the PRO698 amino acid sequence and the following Dayhoff sequences, OLFM_RANCA, I73637, AB006686S3_1, RNU78105_1, RNU72487_1, P_R98225, CELC48E7_4, CEF11C3_3, XLU85970_1 and S42257.

Example 20

Isolation of cDNA Clones Encoding Human PRO732

A yeast screening assay was employed to identify cDNA clones that encoded potential secreted proteins. Use of this

```
forward PCR primer   5'-AGCTGTGGTCATGGTGGTGTGGTG-3'   (SEQ ID NO:69)

reverse PCR primer   5'-CTACCTTGGCATAGGTGATCCGC-3'    (SEQ ID NO:70)
```

Additionally, a synthetic oligonucleotide hybridization probe was constructed from the consensus DNA39906 sequence which had the following nucleotide sequence Hybridization Probe
5'-CATCAGCAAACCGTCTGTGGTTCAGCTCAACT GGAGAGGGTT-3' (SEQ ID NO:71)

In order to screen several libraries for a source of a full-length clone, DNA from the libraries was screened by PCR amplification with the PCR primer pair identified above. A positive library was then used to isolate clones encoding the PRO698 gene using the probe oligonucleotide and one of the PCR primers. RNA for construction of the cDNA libraries was isolated from human bone marrow tissue (LIB255). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orienyeast screening assay allowed identification of a single cDNA clone whose sequence (herein designated as DNA42580) is shown in FIG. 45 (SEQ ID NO:77). The DNA42580 sequence was then compared to a variety of known EST sequences to identify homologies. The EST databases employed included public EST databases (e.g., GenBank) and a proprietary EST DNA database (LIFESEQ®, Incyte Pharmaceuticals, Palo Alto, Calif.). The search was performed using the computer program BLAST or BLAST2 (Altshul et al., *Methods in Enzymology* 266:460480 (1996)) as a comparison to a 6 frame translation of the EST sequence. Those comparisons resulting in a BLAST score of 70 (or in some cases 90) or greater that did not encode known proteins were clustered and assembled into consensus DNA sequences with the program "phrap" (Phil Green, University of Washington, Seattle, Wash.).

Using the above analysis, a consensus DNA sequence was assembled relative to other EST sequences using phrap. This consensus sequence is herein designated consen01. Proprietary Genentech EST sequences were employed in the consensus assembly and they are herein designated DNA20239 (FIG. 42; SEQ ID NO:74), DNA38050 (FIG. 43; SEQ ID NO:75) and DNA40683 (FIG. 44; SEQ ID NO:76).

Based on the consen01 sequence, oligonucleotides were synthesized: 1) to identify by PCR a cDNA library that contained the sequence of interest, and 2) for use as probes to isolate a clone of the full-length coding sequence for PRO732. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., Current Protocols in Molecular Biology, with the PCR primer pair. A positive library was then used to isolate clones encoding the gene of interest using the probe oligonucleotide and one of the primer pairs.

PCR primers (forward and reverse) were synthesized:

| | | |
|---|---|---|
| forward PCR primer | 5'-ATGTTTGTGTGGAAGTGCCCCG-3' | (SEQ ID NO:78) |
| forward PCR primer | 5'-GTCAACATGCTCCTCTGC-3' | (SEQ ID NO:79) |
| reverse PCR primer | 5'-AATCCATTGTGCACTGCAGCTCTAGG-3' | (SEQ ID NO:80) |
| reverse PCR primer | 5'-GAGCATGCCACCACTGGACTGAC-3' | (SEQ ID NO:81) |

Additionally, a synthetic oligonucleotide hybridization probe was constructed from the consensus DNA44143 sequence which had the following nucleotide sequence
Hybridization Probe
5'-GCCGATGCTGTCCTAGTGGAAACAACTCCACT
GTAACTAGATTGATCTATGCAC-3' (SEQ ID NO:82)

In order to screen several libraries for a source of a full-length clone, DNA from the libraries was screened by PCR amplification with the PCR primer pairs identified above. A positive library was then used to isolate clones encoding the PRO732 gene using the probe oligonucleotide and one of the PCR primers.

RNA for construction of the cDNA libraries was isolated from human fetal lung tissue (LIB26). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., Science, 253:1278–1280 (1991)) in the unique XhoI and NotI sites.

A full length clone was identified that contained a single open reading frame with an apparent translational initiation site at nucleotide positions 88–90 and ending at the stop codon found at nucleotide positions 1447–1449 (FIG. 40, SEQ ID NO:72). The predicted polypeptide precursor is 453 amino acids long, has a calculated molecular weight of approximately 50,419 daltons and an estimated pI of approximately 5.78. Analysis of the full-length PRO732 sequence shown in FIG. 41 (SEQ ID NO:73) evidences the presence of the following: a signal peptide from about amino acid 1 to about amino acid 28, transmembrane domains from about amino acid 37 to about amino acid 57, from about amino acid 93 to about amino acid 109, from about amino acid 126 to about amino acid 148, from about amino acid 151 to about amino acid 172, from about amino acid 197 to about amino acid 215, from about amino acid 231 to about amino acid 245, from about amino acid 260 to about amino acid 279, from about amino acid 315 to about amino acid 333, from about amino acid 384 to about amino acid 403 and from about amino acid 422 to about amino acid 447, potential N-glycosylation sites from about amino acid 33 to about amino acid 36, from about amino acid 34 to about amino acid 37, from about amino acid 179 to about amino acid 183, from about amino acid 298 to about amino acid 301, from about amino acid 337 to about amino acid 340 and from about amino acid 406 to about amino acid 409, an amino acid block having homology to the MIP family of proteins from about amino acid 119 to about amino acid 149 and an amino acid block having homology to DNA/RNA non-specific endonuclease proteins from about amino acid 279 to about amino acid 286. Clone DNA48334-1435 has been deposited with ATCC on Jun. 2, 1998 and is assigned ATCC deposit no. 209924.

Analysis of the amino acid sequence of the full-length PRO732 polypeptide suggests that it possesses significant sequence similarity to the Diff33 protein, thereby indicating that PRO732 may be a novel Diff33 homolog. More specifically, an analysis of the Dayhoff database (version 35.45 SwissProt 35) evidenced significant homology between the PRO732 amino acid sequence and the following Dayhoff sequences, HS179M20_2, MUSTETU_1, CER11H6_2, RATDRP_1, S51256, E69226, AE000869_1, JC4120, CYB_PARTE and P_R50619.

Example 21

Isolation of cDNA Clones Encoding Human PRO120

A consensus DNA sequence was assembled relative to other EST sequences using phrap as described in Example 1 above. This consensus sequence is designated herein consen0352. The consen0352 sequence was then extended using repeated cycles of BLAST and phrap to extend the consensus sequence as far as possible using the sources of EST sequences discussed above. The extended consensus sequence is designated herein as DNA34365. Based on the DNA34365 consensus sequence, oligonucleotides were synthesized: 1) to identify by PCR a cDNA library that contained the sequence of interest, and 2) for use as probes to isolate a clone of the full-length coding sequence for PRO1120.

PCR primers (forward and reverse) were synthesized:

| | | |
|---|---|---|
| forward PCR primers: | 5'-GAAGCCGGCTGTCTGAATC-3' | (SEQ ID NO:85), |
| | 5'-GGCCAGCTATCTCCGCAG-3' | (SEQ ID NO:86), |
| | 5'-AAGGGCCTGCAAGAGAAG-3' | (SEQ ID NO:87), |
| | 5'-CACTGGGACAACTGTGGG-3' | (SEQ ID NO:88), |
| | 5'-CAGAGGCAACGTGGAGAG-3' | (SEQ ID NO:89), and |
| | 5'-AAGTATTGTCATACAGTGTTC-3' | (SEQ ID NO:90); |
| reverse PCR primers: | 5'-TAGTACTTGGGCACGAGGTTGGAG-3' | (SEQ ID NO:91), and |
| | 5'-TCATACCAACTGCTGGTCATTGGC-3' | (SEQ ID NO:92). |

Additionally, a synthetic oligonucleotide hybridization probe was constructed from the DNA34365 consensus sequence which had the following nucleotide sequence:
Hybridization Probe:
5'-CTCAAGCTGCTGGACACGGAGCGGCCGGTGA ATCGGTTTCACTTG-3' (SEQ ID NO:93).

In order to screen several libraries for a source of a full-length clone, DNA from the libraries was screened by PCR amplification with the PCR primer pairs identified above. A positive library was then used to isolate clones encoding the PRO1120 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1120 (designated herein as DNA48606-1479 [FIG. 46, SEQ ID NO:83]; and the derived protein sequence for PRO1120.

The entire coding sequence of PRO1120 is shown in FIG. 46 (SEQ ID NO:83). Clone DNA48606-1479 contains a single open reading frame with an apparent translational initiation site at nucleotide positions 608–610 and an apparent stop codon at nucleotide positions 3209–3211. The predicted polypeptide precursor is 867 amino acids long. The full-length PRO1120 protein shown in FIG. 47 has an estimated molecular weight of about 100,156 Daltons and a pI of about 9.44. Additional features of the PRO1120 polypeptide include a signal peptide at about amino acids 1–17; a sulfatase signature at about amino acids 86–98; regions of homology to sulfatases at about amino acids 87–106, 133–146, 216–229, 291–320, and 365–375; and potential N-glycosylation sites at about amino acids 65–68, 112–115, 132–135, 149–152, 171–174, 198–201, 241–245, 561–564, 608–611, 717–720, 754–757, and 764–767.

An analysis of the Dayhoff database (version 35.45 SwissProt 35), using a WU-BLAST-2 sequence alignment analysis of the full-length sequence shown in FIG. 47 (SEQ ID NO:84), revealed significant homology between the PRO1120 amino acid sequence and the following Dayhoff sequences: CELK09C4_1, GL6S_HUMAN, G65169, NCU89492_1, BCU448521, E64903, P_R51355, STS_HUMAN, GA6S_HUMAN, and IDS_MOUSE. Clone DNA48606-1479 was deposited with the ATCC on Jul. 1, 1998, and is assigned ATCC deposit no. 203040.

Example 22

Isolation of cDNA Clones Encoding Human PRO537

Use of the signal sequence algorithm described in Example 3 above allowed identification of an EST cluster sequence from the Incyte database, designated as Incyte EST cluster no. 29605. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA48350.

In light of an observed sequence homology between the DNA48350 consensus sequence and an EST sequence encompassed within the Merck EST clone no. R63443, the Merck EST clone R63443 was purchased and the cDNA insert was obtained and sequenced. It was found that this insert encoded a full-length protein. The sequence of this cDNA insert is shown in FIG. 48 and is herein designated as DNA49141-1431.

Clone DNA49141-1431 contains a single open reading frame with an apparent translational initiation site at nucleotide positions 97–99 and ending at the stop codon at nucleotide positions 442–444 (FIG. 48). The predicted polypeptide precursor is 115 amino acids long (FIG. 49). The full-length PRO537 protein shown in FIG. 49 has an estimated molecular weight of about 13,183 daltons and a pI of about 12.13. Analysis of the full-length PRO537 sequence shown in FIG. 49 (SEQ ID NO:95) evidences the presence of the following: a signal peptide from about amino acid 1 to about amino acid 31, a potential N-glycosylation site from about amino acid 44 to about amino acid 47, potential N-myristolation sites from about amino acid 3 to about amino acid 8 and from about amino acid 16 to about amino acid 21 and an amino acid block having homology to multicopper oxidase proteins from about amino acid 97 to about amino acid 105. Clone DNA49141-1431 has been deposited with ATCC on Jun. 23, 1998 and is assigned ATCC deposit no. 203003.

An analysis of the Dayhoff database (version 35.45 SwissProt 35), using a WU-BLAST-2 sequence alignment analysis of the full-length sequence shown in FIG. 49 (SEQ ID NO:95), evidenced homology between the PRO537 amino acid sequence and the following Dayhoff sequences: A54523, CELF22H10_2, FKH4_MOUSE, OTX1_HUMAN, URB1_USTMA, KNOB_PLAFN, A32895_1, AF036332_1, HRG_HUMAN and HRP3_PLAFS.

Example 23

Isolation of cDNA Clones Encoding Human PRO536

Use of the signal sequence algorithm described in Example 3 above allowed identification of an EST cluster sequence from the Incyte database, designated herein as ss.clu2437.init. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA48351.

In light of an observed sequence homology between the DNA48351 consensus sequence and an EST sequence encompassed within the Merck EST clone no. H11129, the Merck EST clone H11129 was purchased and the cDNA insert was obtained and sequenced. It was found that this insert encoded a full-length protein. The sequence of this cDNA insert is shown in FIG. 50 and is herein designated as DNA49142-1430.

Clone DNA49142-1430 contains a single open reading frame with an apparent translational initiation site at nucleotide positions 48–50 and ending at the stop codon at nucleotide positions 987–989 (FIG. 50). The predicted polypeptide precursor is 313 amino acids long (FIG. 51). The full-length PRO536 protein shown in FIG. 51 has an estimated molecular weight of about 34,189 daltons and a pI of about 4.8. Analysis of the full-length PRO536 sequence shown in FIG. 51 (SEQ ID NO:97) evidences the presence of the following: a signal peptide from about amino acid 1 to about amino acid 25, a potential N-glycosylation site from about amino acid 45 to about amino acid 48 and an amino acid sequence block having homology to sulfatase proteins from about amino acid 16 to about amino acid 26. Clone DNA49142-1430 has been deposited with ATCC on Jun. 23, 1998 and is assigned ATCC deposit no. 203002.

An analysis of the Dayhoff database (version 35.45 SwissProt 35), using a WU-BLAST-2 sequence alignment analysis of the full-length sequence shown in FIG. 51 (SEQ ID NO:97), evidenced homology between the PRO536 amino acid sequence and the following Dayhoff sequences: APU46857_1, PK2_DICDI, H64743, F5114_18, CEAM_*ECOLI*, GEN14267, H64965, TCU39815_1, PSBJ_ODOSI and P_R06980.

Example 24

Isolation of cDNA Clones Encoding Human PRO535

Use of the signal sequence algorithm described in Example 3 above allowed identification of an EST cluster sequence from the Incyte database, designated herein as ss.clu12694.init. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA48352. Two propietary Genentech EST sequences were employed in the assembly are are herein shown in FIGS. 54 and 55.

In light of an observed sequence homology between the DNA48352 consensus sequence and an EST sequence encompassed within the Merck EST clone no. H86994, the Merck EST clone H86994 was purchased and the cDNA insert was obtained and sequenced. It was found that this insert encoded a full-length protein. The sequence of this cDNA insert is shown in FIG. 52 and is herein designated as DNA49143-1429.

Clone DNA49143-1429 contains a single open reading frame with an apparent translational initiation site at nucleotide positions 78–80 and ending at the stop codon at nucleotide positions 681–683 (FIG. 52). The predicted polypeptide precursor is 201 amino acids long (FIG. 53). The full-length PRO535 protein shown in FIG. 53 has an estimated molecular weight of about 22,180 daltons and a pI of about 9.68. Analysis of the full-length PRO535 sequence shown in FIG. 53 (SEQ ID NO:99) evidences the presence of the following: a signal peptide from about amino acid 1 to about amino acid 25, a transmembrane domain from about amino acid 155 to about amino acid 174, a potential N-glycosylation site from about amino acid 196 to about amino acid 199 and FKBP-type peptidyl-prolyl cis-trans isomer signature sequences from about amino acid 62 to about amino acid 77, from about amino acid 87 to about amino acid 123 and from about amino acid 128 to about amino acid 141. Clone DNA49143-1429 has been deposited with ATCC on Jun. 23, 1998 and is assigned ATCC deposit no. 203013.

An analysis of the Dayhoff database (version 35.45 SwissProt 35), using a WU-BLAST-sequence alignment analysis of the full-length sequence shown in FIG. 53 (SEQ ID NO:99), evidenced homology between the PRO535 amino acid sequence and the following Dayhoff sequences: S71237, P_R93551, P_R28980, S71238, FKB2_HUMAN, CELC05C8_1, S55383, S72485, CELC50F2_6 and S75144.

Example 25

Isolation of cDNA Clones Encoding Human PRO718

A cDNA sequence isolated in the amylase screen described in Example 2 (human fetal lung library) above is herein designated DNA43512 (see FIG. 62; SEQ ID NO:108). The DNA43512 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et ale, *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated DNA45625. Proprietary Genentech EST sequences were employed in the assembly and are herein shown in FIGS. 58-61.

Based on the DNA45625 sequence, oligonucleotide probes were generated and used to screen a human fetal lung library (LIB25) prepared as described in paragraph 1 of Example 2 above. The cloning vector was pRK5B (pRK5B is a precursor of pRK5D that does not contain the SfiI site; see, Holmes et al., *Science*, 253:1278–1280 (1991)), and the cDNA size cut was less than 2800 bp.

PCR primers (forward and reverse) were synthesized:

forward PCR primer 5'-GGGTGGATGGTACTGCTGCATCC-3' (SEQ ID NO:109)
reverse PCR primer 5'-TGTTGTGCTGTGGGAAATCAGATGTG-3' (SEQ ID NO:110)

Additionally, a synthetic oligonucleotide hybridization probe was constructed from the DNA45625 sequence which had the following nucleotide sequence:
Hybridization Probe
5'-GTGTCTGGAGGCTGTGGCCGTTTTGTTTTCTTG GGCTAAAATCGGG-3' (SEQ ID NO:111)

In order to screen several libraries for a source of a full-length clone, DNA from the libraries was screened by PCR amplification with the PCR primer pair identified above. A positive library was then used to isolate clones encoding the PRO718 gene using the probe oligonucleotide and one of the PCR primers.

A full length clone was identified that contained a single open reading frame with an apparent translational initiation site at nucleotide positions 36–38 and ending at the stop codon found at nucleotide positions 607–609 (FIG. 56; SEQ ID NO:102). The predicted polypeptide precursor is 157 amino acids long, has a calculated molecular weight of approximately 17,400 daltons and an estimated pI of approximately 5.78. Analysis of the full-length PRO718 sequence shown in FIG. 57 (SEQ ID NO:103) evidences the presence of the following: a type II transmembrane domain from about amino acid 21 to about amino acid 40, and other transmembrane domains at about amino acid 58 to about amino acid 78, about amino acid 95 to about amino acid 114, and about amino acid 127 to about amino acid 147; a cell attachment sequence from about amino acid 79 to about amino acid 81; and a potential N-glycosylation site from about amino acid 53 to about amino acid 56. Clone DNA49647-1398 has been deposited with ATCC on Jun. 2, 1998 and is assigned ATCC deposit no. 209919.

Analysis of the amino acid sequence of the full-length PRO718 polypeptide suggests that it possesses no significant sequence similarity to any known protein. However, an analysis of the Dayhoff database (version 35.45 SwissProt 35) evidenced some degree of homology between the PRO718 amino acid sequence and the following Dayhoff sequences: AF045606_1, AF039906_1, SPBC8D2_2, S63441, F64728, COX_TRYBB, F64375, E64173, RPYGJT_3, MTCY261_23.

Example 26

Isolation of cDNA Clones Encoding Human PRO872

Use of the signal sequence algorithm described in Example 3 above allowed identification of a single Incyte EST sequence designated herein as clu120709.init. The clu120709.init sequence was then compared a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA48254.

In light of an observed sequence homology between the DNA48254 consensus sequence and an EST sequence encompassed within the Incyte EST clone no. 3438068, the Incyte EST clone 3438068 was purchased and the cDNA insert was obtained and sequenced. It was found that this insert encoded a full-length protein. The sequence of this cDNA insert is shown in FIG. 63 and is the full-length DNA sequence for PRO872. Clone DNA49819-1439 was deposited with the ATCC on Jun. 2, 1998, and is assigned ATCC deposit no. 209931.

The entire nucleotide sequence of DNA49819-1439 is shown in FIG. 63 (SEQ ID NO:112). Clone DNA49819-1439 contains a single open reading frame with an apparent translational initiation site at nucleotide positions 14–16 and ending at the stop codon at nucleotide positions 1844–1846 (FIG. 63). The predicted polypeptide precursor is 610 amino acids long (FIG. 64). The full-length PRO872 protein shown in FIG. 64 has an estimated molecular weight of about 66,820 daltons and a pI of about 8.65. Analysis of the full-length PRO872 sequence shown in FIG. 64 (SEQ ID NO:113) evidences the presence of the following features: a signal peptide at amino acid 1 to about 18, putative transmembrane domains at about amino acids 70–87, 200–222 and 568–588; sequence identity with bacterial-type phytoene dehydrogenase protein at about amino acids 71–105; sequence identity with a regulator of chromosome condensation (RCC1) signature 2 at about amino acids 201–211; leucine zipper patterns at about amino acids 214–235, 221–242, 228–249 and 364–385; a potential N-glycosylation site at about amino acids 271–274; and a glycosaminoglycan attachment site at about amino acids 75–78. Analysis of the amino acid sequence of the full-length PRO872 polypeptide using the Dayhoff database (version 35.45 SwissProt 35) evidenced homology between the PRO872 amino acid sequence and the following Dayhoff sequences: PRCRTI_1, S75951, S74689, CELF37C4_3, CRTI_RHOCA, S76617, YNI2_METTL, MTV014_14, AOFB_HUMAN, and MMU70429_1.

Example 27

Isolation of cDNA Clones Encoding Human PRO1063

Use of the signal sequence algorithm described in Example 3 above allowed identification of a single Incyte EST cluster sequence designated herein as ss.clu119743.init. The Incyte EST cluster sequence ss.clu119743.init sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA48288.

In light of an observed sequence homology between the DNA48288 consensus sequence and an EST sequence encompassed within the Incyte EST clone no. 2783726, the Incyte EST clone 2783726 was purchased and the cDNA insert was obtained and sequenced. It was found that this insert encoded a full-length protein. The sequence of this cDNA insert is shown in FIG. 65 and is herein designated DNA49820-1427.

The full length clone shown in FIG. 65 contained a single open reading frame with an apparent translational initiation site at nucleotide positions 90–92 and ending at the stop codon found at nucleotide positions 993–995 (FIG. 65; SEQ ID NO:114). The predicted polypeptide precursor is 301 amino acids long, has a calculated molecular weight of approximately 33,530 daltons and an estimated pI of approximately 4.80. Analysis of the full-length PRO1063 sequence shown in FIG. 66 (SEQ ID NO:115) evidences the presence of the following: a signal peptide from about amino acid 1 to about amino acid 21, potential N-glycosylation sites from about amino acid 195 to about amino acid 198, from about amino acid 217 to about amino acid 220 and from about amino acid 272 to about amino acid 275, a glycosaminoglycan attachment site from about amino acid 267 to about amino acid 270, a microbodies C-terminal targeting signal site from about amino acid 299 to about amino acid 301, a type II fibronectin collagen-binding domain homology sequence from about amino acid 127 to about amino acid 168 and a fructose-bisphosphate aldolase class II protein homology sequence from about amino acid 101 to about amino acid 118. Clone DNA49820-1427 has been deposited with the ATCC on Jun. 2, 1998 and is assigned ATCC deposit no. 209932.

Analysis of the amino acid sequence of the full-length PRO1063 polypeptide suggests that it possesses sequence similarity to the human type IV collagenase protein. More specifically, an analysis of the Dayhoff database (version 35.45 SwissProt 35) evidenced some degree of homology between the PRO1063 amino acid sequence and the following Dayhoff sequences, S68303, CFU68533_1, P_P91139, RNU65656_1, PA2R_RABIT, MMU56734_1, FINC_XENLA, A48925, P_R92778 and FA12_HUMAN.

Example 28

Isolation of cDNA Clones Encoding Human PRO619

Use of the signal sequence algorithm described in Example 3 above allowed identification of an EST cluster sequence from the Incyte database, designated herein as 88434. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.).

In light of an observed sequence homology between the consensus sequence and an EST sequence encompassed within the Incyte EST clone no. 1656694, the Incyte EST clone 1656694 was purchased and the cDNA insert was obtained and sequenced. It was found that this insert encoded a full-length protein. The sequence of this cDNA insert is shown in FIG. 67 and is herein designated as DNA49821-1562.

The full length clone shown in FIG. 67 contained a single open reading frame with an apparent translational initiation site at nucleotide positions 81–83 and ending at the stop codon found at nucleotide positions 450–452 (FIG. 67; SEQ ID NO:116). The predicted polypeptide precursor (FIG. 68, SEQ ID NO:117) is 123 amino acids long including a predicted signal peptide at about amino acids 1–20. PRO619 has a calculated molecular weight of approximately 13,710 daltons and an estimated pI of approximately 5.19. Clone DNA49821-1562 was deposited with the ATCC on Jun. 16, 1998 and is assigned ATCC deposit no. 209981.

An analysis of the Dayhoff database (version 35.45 SwissProt 35), using a WU-BLAST-2 sequence alignment analysis of the full-length sequence shown in FIG. 68 (SEQ ID NO:117), revealed significant homology between the PRO619 amino acid sequence and the following Dayhoff sequences: S35302, D87009_1, HSU93494_1, HUMIGLAM5_1, D86999_2, HUMIGLYM1_1, HUMIGLYMKE_1, A29491_1, A29498_1, and VPR2_MOUSE.

Example 29

Isolation of cDNA Clones Encoding Human PRO943

A consensus DNA sequence encoding PRO943 was assembled relative to other EST sequences using phrap as described in Example 1 above. This consensus sequence was then extended using repeated cycles of BLAST and phrap to extend the consensus sequence as far as possible using the sources of EST sequences discussed above. The extended consensus sequence is herein designated DNA36360. Based on the DNA36360 consensus sequence, oligonucleotides were synthesized: 1) to identify by PCR a cDNA library that contained the sequence of interest, and 2) for use as probes to isolate a clone of the full-length coding sequence for PRO943.

PCR primers (forward and reverse) were synthesized:

```
forward PCR primer  5'-CGAGATGACGCCGAGCCCCC-3'   (SEQ ID NO:120)
reverse PCR primer  5'-CGGTTCGACACGCGGCAGGTG-3'  (SEQ ID NO:121)
```

Additionally, a synthetic oligonucleotide hybridization probe was constructed from the consensus DNA36360 sequence which had the following nucleotide sequence Hybridization Probe

5'-TGCTGCTCCTGCTGCCGCCGCTGCTGCTGGGG GCCTTCCCGCCGG-3' (SEQ ID NO:122)

In order to screen several libraries for a source of a full-length clone, DNA from the libraries was screened by PCR amplification with the PCR primer pair identified

```
forward PCR primer  5'-CTGGTGCCTCAACAGGGAGCAG-3'  (SEQ ID NO:125)
reverse PCR primer  5'-CCATTGTGCAGGTCAGGTCACAG-3'  (SEQ ID NO:126)
``` above. A positive library was then used to isolate clones encoding the PRO943 gene using the probe oligonucleotide and one of the PCR primers. RNA for construction of the cDNA libraries was isolated from human fetal brain tissue.

DNA sequencing of the clones isolated as described above gave the full-length DNA sequence for PRO943 (designated herein as DNA52192-1369 [FIG. 69, SEQ ID NO:118]) and the derived protein sequence for PRO943.

The entire nucleotide sequence of DNA52192-1369 is shown in FIG. 69 (SEQ ID NO:118). Clone DNA52192-1369 contains a single open reading frame with an apparent translational initiation site at nucleotide positions 150–152 and ending at the stop codon at nucleotide positions 1662–1664 (FIG. 69). The predicted polypeptide precursor is 504 amino acids long (FIG. 70). The full-length PRO943 protein shown in FIG. 70 has an estimated molecular weight of about 54,537 daltons and a pI of about 10.04. Analysis of the full-length PRO943 sequence shown in FIG. 70 (SEQ ID NO:119) evidences the presence of the following: a signal peptide from about amino acid 1 to about amino acid 17, a transmembrane domain from about amino acid 376 to about amino acid 396, tyrosine kinase phosphorylation sites from about amino acid 212 to about amino acid 219 and from about amino acid 329 to about amino acid 336, potential N-glycosylation sites from about amino acid 111 to about amino acid 114, from about amino acid 231 to about amino acid 234, from about amino acid 255 to about amino acid 258 and from about amino acid 293 to about amino acid 296 and an immunoglobulin and MHC protein sequence homology block from about amino acid 219 to about amino acid 236. Clone DNA52192-1369 has been deposited with ATCC on Jul. 1, 1998 and is assigned ATCC deposit no. 203042.

An analysis of the Dayhoff database (version 35.45 SwissProt 35), using a WU-BLAST-2 sequence alignment analysis of the full-length sequence shown in FIG. 70 (SEQ ID NO:119), evidenced significant homology between the PRO943 amino acid sequence and the following Dayhoff sequences: B49151, A39752, FGR1_XENLA, S38579, RATHBFGFRB_1, TVHU2F, FGR2_MOUSE, CEK3_CHICK, P_R21080 and A27171_1.

Example 30

Isolation of cDNA Clones Encoding Human PRO1188

A consensus DNA sequence was assembled relative to other EST sequences using the program "phrap" as described in Example 1 above. This consensus sequence is designated herein as DNA45679. Based on the DNA45679 consensus sequence, oligonucleotides were synthesized: 1) to identify by PCR a cDNA library that contained the sequence of interest, and 2) for use as probes to isolate a clone of the full-length coding sequence for PRO1188.

PCR primers (forward and reverse) were synthesized:

Additionally, a synthetic oligonucleotide hybridization probe was constructed from the consensus DNA45679 sequence which had the following nucleotide sequence:
Hybridization Probe
5'-CTGGAGCAAGTGCTCAGCTGCCTGTGGTCAGA
CTGGGGTC-3' (SEQ ID NO:127)

In order to screen several libraries for a source of a full-length clone, DNA from the libraries was screened by PCR amplification with the PCR primer pair identified above. A positive library was then used to isolate clones encoding the PRO1188 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1188 (designated herein as DNA52598-1518 [FIG. 71, SEQ ID NO:123]); and the derived protein sequence for PRO1188.

The entire coding sequence of PRO1188 is shown in FIG. 71 (SEQ ID NO:123). Clone DNA52598-1518 contains a single open reading frame with an apparent translational initiation site at nucleotide positions 136–138 and an apparent stop codon at nucleotide positions 3688–3690. The predicted polypeptide precursor is 1184 amino acids long. The full-length PRO1188 protein shown in FIG. 72 has an estimated molecular weight of about 132,582 Daltons and a pI of about 8.80. Additional features include: a signal peptide at about amino acids 1–31; an ATP/GTP binding site motif A (P-loop) at about amino acids 266–273; an aldehyde dehydrogenases cysteine active site at about amino acids 188–199; growth factor and cytokines receptors family signature 2 at about amino acids 153–159; and potential N-glycosylation sites at about amino acids 129–132, 132–135, 346–349, 420423, 550–553, 631–634, 1000–1003, and 1056–1059.

An analysis of the Dayhoff database (version 35.45 SwissProt 35), using a WU-BLAST-2 sequence alignment analysis of the full-length sequence shown in FIG. 72 (SEQ ID NO:124), revealed significant homology between the PRO1188 amino acid sequence and the following Dayhoff sequences: SSU83114_1, S56015, CET21B6_4, CELT19D2_1, and TSP1_MOUSE.

Clone DNA52598-1518 has been deposited with ATCC and is assigned ATCC deposit no 203107.

Example 31

Isolation of cDNA Clones Encoding Human PRO1133

A consensus DNA sequence was assembled relative to other EST sequences using phrap as described in Example 1 above. This sequence was extended using repeated cycles of phrap. The extended consensus sequence is designated herein DNA38102. Based on the DNA38102 consensus sequence, oligonucleotides were synthesized: 1) to identify by PCR a cDNA library that contained the sequence of interest, and 2) for use as probes to isolate a clone of the full-length coding sequence for PRO1133.

PCR primers (two forward and one reverse) were synthesized:

forward PCR primer 1  5'-TCGATTATGGACGAACATGGCAGC-3'  (SEQ ID NO:130);
forward PCR primer 2  5'-TTCTGAGATCCCTCATCCTC-3'     (SEQ ID NO:131); and
reverse primer        5'-AGGTTCAGGGACAGCAAGTTTGGG-3' (SEQ ID NO:132).

Additionally, a synthetic oligonucleotide hybridization probe was constructed from the consensus DNA38102 sequence which had the following nucleotide sequence:
Hybridization Probe
5'TTTGCTGGACCTCGGCTACGGAATTG-GCTTCCCTCTACGGACAGCTGGAT3' (SEQ ID NO:133).

In order to screen several libraries for a source of a full-length clone, DNA from the libraries was screened by PCR amplification with a PCR primer pair identified above. A positive library was then used to isolate clones encoding the PRO1133 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1133 and the derived protein sequence for PRO1133.

The entire coding sequence of PRO1133 is shown in FIG. 73 (SEQ ID NO:128). Clone DNA53913-1490 contains a single open reading frame with an apparent translational initiation site at nucleotide positions 266–268 and an apparent stop codon at nucleotide positions 1580–1582 of SEQ ID NO:128. The predicted polypeptide precursor is 438 amino acids long. The signal peptide is at amino acids 1–18 of SEQ ID NO:129. EGF-like domain cysteine pattern signatures start at 315 and 385 of SEQ ID NO:129 as shown in FIG. 74. Clone DNA53913-1490 has been deposited with ATCC and is assigned ATCC deposit no. 203162. The full-length PRO1133 protein shown in FIG. 74 has an estimated molecular weight of about 49,260 daltons and a pI of about 6.15.

An analysis of the Dayhoff database (version 35.45 SwissProt 35), using a WU-BLAST-2 sequence alignment analysis of the full-length sequence shown in FIG. 74 (SEQ ID NO:129), revealed some sequence identity between the PRO1133 amino acid sequence and the following Dayhoff sequences (data from the database incorporated herein): AF0027171, LMG1_HUMAN, B54665, UNC6_CAEEL, LML1_CAEEL, LMA5_MOUSE, MMU88353_1, LMA1_HUMAN, HSLN2C64_1 and AF005258_1.

Example 32

Isolation of cDNA Clones Encoding Human PRO784

An initial DNA sequence (SEQ ID NO:136), referred to herein as DNA44661 and shown in FIG. 77, was identified using a yeast screen, in a human fetal lung cDNA library that preferentially represents the 5' ends of the primary cDNA clones. DNA44661 was then compared to ESTs from public databases (e.g., GenBank), and a proprietary EST database (LIFESEQ®, Incyte Pharmaceuticals, Palo Alto, Calif.), using the computer program BLAST or BLAST2 [Altschul et al., Methods in Enzymology, 266:460–480 (1996)]. The ESTs were then clustered and assembled into a consensus DNA sequence using the computer program "phrap" (Phil Green, University of Washington, Seattle, Wash.). The consensus sequence obtained is designated herein as "DNA45463". Based on the DNA45463 consensus sequence, oligonucleotides were synthesized for use as probes to isolate a clone of the full-length coding sequence for PRO784 from a human fetal lung cDNA library.

The full length DNA53978-1443 clone shown in FIG. 75 contained a single open reading frame with an apparent translational initiation site at nucleotide positions 37–39 and ending at the stop codon found at nucleotide positions 821–823 (FIG. 75; SEQ ID NO:134). The predicted polypeptide precursor (FIG. 76, SEQ ID NO:135) is 228 amino acids long. PRO784 has a calculated molecular weight of approximately 25,735 Daltons and an estimated pI of approximately 5.45. PRO784 has the following features: a signal peptide at about amino acid 1 to about 15; transmembrane domains at about amino acids 68 to about 87 and at about 183 to about 204; potential N-myristoylation sites at about amino acids 15–20, 51–56, 66–60, 163–168, and 206–211; and an RNP-1 protein RNA-binding region at about amino acids 108 to about 117.

Clone DNA53978-1443 was deposited with ATCC on Jun. 16, 1998, and is assigned ATCC deposit no. 209983.

Based on a BLAST and FastA sequence alignment analysis (using the ALIGN computer program) of the full-length sequence, PRO784 shows amino acid sequence identity to the following proteins: RNU42209_1, MMU91538_1, CGU91742_1, CELF55A4_6, SC22_YEAST, and F48188.

Example 33

Isolation of cDNA Clones Encoding Human PRO783

A yeast screening assay was employed to identify cDNA clones that encoded potential secreted proteins. Use of this yeast screening assay allowed identification of a single cDNA clone, designated herein as DNA45201 (FIG. 80; SEQ ID NO:139).

The DNA45201 sequence was then used to search expressed sequence tag (EST) databases for the presence of potential homologies. The EST databases included public EST databases (e.g., GenBank) and a proprietary EST DNA database (LIFESEQ™, Incyte Pharmaceuticals, Palo Alto, Calif.). The search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained is herein designated as "consen01". A proprietary Genentech EST sequence was used in the consensus assembly and is herein designated as DNA14575 (FIG. 81; SEQ ID NO:140).

Based (n the consen01 sequence, oligonucleotides were synthesized: 1) to identify by PCR a cDNA library that contained the sequence of interest, and 2) for use as probes to isolate a clone of the full-length coding sequence for PRO783. In order to screen several libraries for a full-length clone, DNA from the libraries was screened by PCR amplification, as per Ausubel et al., Current Protocols in Molecular Biology, with the PCR primer pair. A positive library was then used to isolate clones encoding the gene of interest using the probe oligonucleotide and one of the primer pairs.

PCR primers (forward and reverse) were synthesized:

```
forward PCR primer  5'-GACTGTATCTGAGCCCCAGACTGC-3'  (SEQ ID NO:141),
forward PCR primer  5'-TCAGCAATGAGGTGCTGCTC-3'      (SEQ ID NO:142), and
reverse PCR primer  5'-TGAGGAAGATGAGGGACAGGTTGG-3'  (SEQ ID NO:143).
```

Additionally, a synthetic oligonucleotide hybridization probe was constructed from the consen01 sequence which had the following nucleotide sequence:
Hybridization Probe
5'-TATGGAAGCACCTGACTACGAAGTGCTATCCGT GCGAGAACAGCTATTCC-3' (SEQ ID NO:144).

In order to screen several libraries for a source of a full-length clone, DNA from the libraries was screened by PCR amplification with a PCR primer pair identified above. A positive library was then used to isolate clones encoding the PRO783 gene using the probe oligonucleotide and one of the PCR primers.

RNA for construction of the cDNA libraries was isolated from human fetal kidney tissue (LIB228). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for PRO783 [herein designated as DNA53996-1442] (SEQ ID NO:137) and the derived protein sequence for PRO783.

The entire nucleotide sequence of DNA53996-1442 is shown in FIG. 78 (SEQ ID NO:137). Clone DNA53996-1442 contains a single open reading frame with an apparent translational initiation site at nucleotide positions 310–312 and ending at the stop codon at nucleotide positions 1777–1779 (FIG. 78). The predicted polypeptide precursor is 489 amino acids long (FIG. 79). The full-length PRO783 protein shown in FIG. 79 has an estimated molecular weight of about 55,219 daltons and a pI of about 8.47. Analysis of the full-length PRO783 sequence shown in FIG. 79 (SEQ ID NO:138) evidences the presence of the following features: transmembrane domains located at about amino acids 23–42, 67–89, 111–135, 154–176, 194–218, 296–319, 348–370, 387–410 and 427–452; leucine zipper patterns located at about amino acids 263–283 and 399–420; a potential tyrosine kinase phosphorylation site at about amino acids 180–187; potential N-glycosylation sites at about amino acids 105–108 and 121–124; potential cAMP- and a cGMP-dependent protein kinase phosphorylation site at about amino acids 288–291; and a region having sequence identity with bacterial rhodopsins retinal binding site protein at about amino acids 190–218.

An analysis of the Dayhoff database (version 35.45 SwissProt 35) shows some sequence identity between the PRO783 amino acid sequence and the following Dayhoff sequences: YNC2_CAEEL, D64048, ATAC002332_ 3F4P9.3, NY2R_SHEEP, and VSH_MUMPA.

Clone DNA53996-1442 was deposited with the ATCC on Jun. 2, 1998, and is assigned ATCC deposit no. 209921.

Example 34

Isolation of cDNA Clones Encoding Human PRO820

An expressed sequence tag (EST) DNA database (Merck/Wash. U) was searched and an EST designated EST no. AA504080, Merck clone 825136, was identified (library 312, human B-cell tonsil). Homology searches revealed that this EST showed sequence identity with low affinity immunoglobulin gamma Fc receptor II. DNA sequencing gave the full-length DNA sequence for PRO820 and the derived protein sequence for PRO820.

The entire nucleotide sequence of DNA56041-1416 is shown in FIG. 82 (SEQ ID NO:145). Clone DNA56041-1416 contains a single open reading frame with an apparent translational initiation site at nucleotide positions 115–117 and ending at the stop codon at nucleotide positions 487–489 (FIG. 82). The predicted polypeptide precursor is 124 amino acids long (FIG. 83). The full-length PRO820 protein shown in FIG. 83 has an estimated molecular weight of about 14,080 daltons and a pI of about 7.48. Clone DNA56041-1416 has been deposited with ATCC. Regarding the sequence, it is understood that the deposited clone contains the correct sequence, and the sequences provided herein are based on known sequencing techniques.

Still analyzing the amino acid sequence of SEQ ID NO:146, the putative signal peptide is at about amino acids 1–15 of SEQ ID NO:146. Protein kinase C phosphorylation sites are at about amino acids 20–22 and 43–45 of SEQ ID NO:146. An N-myristoylation site is at about amino acids 89–94 of SEQ ID NO:146. An immunoglobulin and major histocompatibility complex domain is at about amino acids 83–90 of SEQ ID NO:146. The corresponding nucleotides can be routinely determined given the sequences provided herein.

Example 35

Isolation of cDNA Clones Encoding Human PRO1080

A consensus DNA sequence was assembled relative to other EST sequences using phrap and was extended using repeated cycles of BLAST and phrap so as to extend the consensus sequence as far as possible using the sources of the EST sequences as described in Example 1 above. The consensus sequence is designated herein as DNA52640. An EST proprietary to Genentech was employed in the consensus assembly and is herein designated as DNA36527 (FIG. 86; SEQ ID NO:149).

In light of an observed sequence homology between the DNA36527 consensus sequence and an EST sequence encompassed within the Merck EST clone no. 526423, the Merck EST clone 526423 was purchased and the cDNA insert was obtained and sequenced. It was found that this insert encoded a full-length protein. The sequence of this cDNA insert is shown in FIG. 84 and is herein designated as DNA56047-1456.

The entire nucleotide sequence of DNA56047-1456 is shown in FIG. 84 (SEQ ID NO:147). Clone DNA56047-1456 contains a single open reading frame with an apparent translational initiation site at nucleotide positions 159–161 and ending at the stop codon at nucleotide positions 1233–1235 of SEQ ID NO:147 (FIG. 84). The predicted polypeptide precursor is 358 amino acids long (FIG. 85). The full-length PRO1080 protein shown in FIG. 85 has an estimated molecular weight of about 40,514 daltons and a pI of about 6.08. Clone DNA56047-1456 has been deposited with ATCC on Jun. 9, 1998. It is understood that the deposited clone has the actual nucleic acid sequence and that the sequences provided herein are based on known sequencing techniques.

Also shown in FIG. 85 are the approximate locations of the signal peptide, cell attachment site, Nt-DnaJ domain signature, region having sequence identity with Nt-DnaJ domain proteins, and N-glycosylation sites. The corresponding nucleic acids of these amino acid sequences and others provided herein can be routinely determined by the information provided herein.

Example 36

Isolation of cDNA Clones Encoding Human PRO1079

A consensus DNA sequence was assembled relative to other EST sequences using phrap as described in Example 1 above, and is herein designated DNA52714. Based on information provided by the assembly, the clone for Merck EST no. H06898 was obtained and sequenced, thereby giving the nucleotide sequence designated herein as DNA56050-1455. The entire nucleotide sequence of DNA56050-1455 is shown in FIG. 87 (SEQ ID NO:150). Clone DNA56050-1455 contains a single open reading frame with an apparent translational initiation site at nucleotide positions 183–185 and ending at the stop codon at nucleotide positions 861–863 (FIG. 87). The predicted polypeptide precursor is 226 amino acids long (FIG. 88). The full-length PRO1079 protein shown in FIG. 88 has an estimated molecular weight of about 24,611 Daltons and a pI of about 4.85. Analysis of the full-length PRO1079 sequence shown in FIG. 88 (SEQ ID NO:3) evidences the presence of the following features: a signal peptide at about amino acid 1–29; potential N-myristoylation sites at about amino acids 10–15, and 51–56; homology to photosystem I psaG and psakproteins at about amino acids 2 to 20; and homology to prolyl endopeptidase family serine proteins at about amino acids 150 to 163.

Analysis of the amino acid sequence of the full-length PRO1079 polypeptide using the Dayhoff database (version 35.45 SwissProt 35) evidenced some sequence identity between the PRO1079 amino acid sequence and the following Dayhoff sequences: CEK10C3_4, MMU50734_1, D69503, AF051149_1, and VSMP_CVMS.

Clone UNQ536 (DNA56050-1455) was deposited with the ATCC on Jun. 22, 1998, and is assigned ATCC deposit no. 203011.

Example 37

Isolation of cDNA Clones Encoding Human PRO793

A cDNA clone (DNA56110-1437) encoding a native human PRO793 polypeptide was identified by a yeast screen, in a human skin tumor cDNA library that preferentially represents the 5' ends of the primary cDNA clones. The yeast screen employed identified a single EST clone designated herein as DNA50177 (FIG. 91; SEQ ID NO:154). The DNA50177 sequence was then compared to various EST databases including public EST databases (e.g., GenBank), and a proprietary EST database (LIFESEQ@, Incyte Pharmaceuticals, Palo Alto, Calif.) to identify homologous EST sequences. The comparison was performed using the computer program BLAST or BLAST2 [Altschul et al., *Methods in Enzymology*, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence is herein designated DNA50972.

In light of an observed sequence homology between the DNA50972 consensus sequence and an EST sequence encompassed within the Merck EST clone no. N33874, the Merck EST clone N33874 was purchased and the cDNA insert was obtained and sequenced. It was found that this insert encoded a full-length protein. The sequence of this cDNA insert is shown in FIG. 89 and is herein designated as DNA56110-1437.

The full-length DNA56110-1437 clone shown in FIG. 89 contains a single open reading frame with an apparent translational initiation site at nucleotide positions 77–79 and ending at the stop codon at nucleotide positions 491–493 (FIG. 89). The predicted polypeptide precursor is 138 amino acids long (FIG. 90). The full-length PRO793 protein shown in FIG. 90 has an estimated molecular weight of about 15,426 daltons and a pI of about 10.67. Analysis of the full-length PRO793 sequence shown in FIG. 90 (SEQ ID NO:153) evidences the presence of the following: transmembrane domains from about amino acid 12 to about amino acid 30, from about amino acid 33 to about amino acid 52, from about amino acid 69 to about amino acid 89 and from about amino acid 93 to about amino acid 109, potential N-myristolation sites from about amino acid 11 to about amino acid 16, from about amino acid 51 to about amino acid 56 and from about amino acid 116 to about amino acid 121 and an amino acid sequence block having homology to an aminoacyl-transfer RNA synthetase class-II protein from about amino acid 49 to about amino acid 59. Clone DNA56110-1437 has been deposited with ATCC on Aug. 11, 1998 and is assigned ATCC deposit no. 203113.

An analysis of the Dayhoff database (version 35.45 SwissProt 35), using a WU-BLAST-2 sequence alignment analysis of the full-length sequence shown in FIG. 90 (SEQ ID NO:153), evidenced certain homology between the PRO793 amino acid sequence and the following Dayhoff sequences: S47453, AF015193_12, MTEHGNS9_2, E64030, H69784, D64995, CD53_MOUSE, GEN8006, AE001138_7 and COX2_STRPU.

Example 38

Isolation of cDNA Clones Encoding Human PRO1016

A consensus DNA sequence was assembled relative to other EST sequences using phrap as described in Example 1 above. The consensus sequence obtained is herein designated DNA53502.

In light of an observed sequence homology between the DNA53502 consensus sequence and an EST sequence encompassed within the Merck EST clone no. 38680, the Merck EST clone 38680 was purchased and the cDNA insert was obtained and sequenced. It was found that this insert encoded a full-length protein. The sequence of this cDNA insert is shown in FIG. 92.

The entire nucleotide sequence of DNA56113-1378 is shown in FIG. 92 (SEQ ID NO:155). Clone DNA56113-1378 contains a single open reading frame with an apparent translational initiation site at nucleotide positions 168–170 and ending at the stop codon at nucleotide positions 1302–1304 (FIG. 92). The predicted polypeptide precursor is 378 amino acids long (FIG. 93). The full-length PRO1016 protein shown in FIG. 93 has an estimated molecular weight of about 44,021 daltons and a pI of about 9.07. Clone DNA56113-1378 has been deposited with the ATCC. Regarding the sequence, it is understood that the deposited clone contains the correct sequence, and the sequences provided herein are based on known sequencing techniques.

Analysis of the amino acid sequence of the full-length PRO1016 polypeptide suggests that portions of it possess sequence identity with acyltransferase, thereby indicating that PRO1016 may be a novel acyltransferase.

Still analyzing the amino acid sequence of SEQ ID NO:156, the putative signal peptide is at about amino acids 1–18 of SEQ ID NO:156. The transmembrane domain(s) are at about amino acids 332–352 and 305–330 of SEQ ID NO:156. The fructose-bisphosphate aldolase class-II protein homology sequence is at about amino acids 73–90 of SEQ ID NO:156. The extradiol ring-cleavage dioxygenase protein is at about amino acids 252–275 of SEQ ID NO:156. The corresponding nucleotides can be routinely determined given the sequences provided herein.

The specific Dayhoff database designation names of sequences to which PRO1016 has sequence identity with include the following: S52645, P_R59712, P_R99249, P_R59713, BNAGPATRF_1, CELT05H4_15 and CELZK40_1.

Example 39

Isolation of cDNA Encoding Human PRO1013

A consensus DNA sequence was assembled relative to other EST sequences using phrap as described in Example 1 above. The consensus DNA sequence was then extended using repeated cycles of BLAST and phrap to extend the consensus sequence as far as possible using the sources of EST sequences.

In light of an observed sequence homology between the consensus sequence and an EST sequence encompassed within the Incyte EST clone no. 3107695, the Incyte EST clone 3107695 was purchased and the cDNA insert was obtained and sequenced. It was found that this insert encoded a full-length protein. The sequence of this cDNA insert is shown in FIG. 94 and is herein designated as DNA56410-1414.

The entire nucleotide sequence of DNA56410-1414 is shown in FIG. 94 (SEQ ID NO:157). Clone DNA56410-1414 contains a single open reading frame with an apparent translational initiation site at nucleotide positions 17–19 and ending at the stop codon at nucleotide positions 1244–1246 (FIG. 94). The predicted polypeptide precursor is 409 amino acids long (FIG. 95). The full-length PRO1013 protein shown in FIG. 95 has an estimated molecular weight of about 46,662 daltons and a pI of about 7.18. Clone DNA56410-1414 has been deposited with the ATCC. Regarding the sequence, it is understood that the deposited clone contains the correct sequence, and the sequences provided herein are based on known sequencing techniques.

Still analyzing the amino acid sequence of SEQ ID NO:158, the putative signal peptide is at about amino acids 1–19 of SEQ ID NO:158. N-glycosylation sites are at about amino acids 75–78 and 322–325 of SEQ ID NO:158. An N-myristoylation site is at about amino acids 184–189 of SEQ ID NO:158. A growth factor and cytokine receptor family domain is at about amino acids 134–149 of SEQ ID NO:158. The corresponding nucleotides can be routinely determined given the sequences provided herein.

Blast analysis showed some sequence identity with other proteins. Specifically, PRO1013 has some sequence identity with at least the Dayhoff sequences designated: D63877_1; MHU22019_1, AE000730_10, and AF019079_1.

Example 40

Isolation of cDNA Clones Encoding Human PRO937

A consensus DNA sequence was assembled relative to other EST sequences using phrap as described in Example 1 above. That consensus sequence is herein designated DNA49651. Based on the DNA49651 consensus sequence, oligonucleotides were synthesized: 1) to identify by PCR a cDNA library that contained the sequence of interest, and 2) for use as probes to isolate a clone of the full-length coding sequence for PRO937.

PCR primers (forward and reverse) were synthesized:

```
forward PCR primer  5'-CTCCGTGGTAAACCCCACAGCCC-3'   (SEQ ID NO:161); and
reverse PCR primer  5'-TCACATCGATGGGATCCATGACCG-3'  (SEQ ID NO:162).
```

Additionally, a synthetic oligonucleotide hybridization probe was constructed from the DNA48651 sequence which had the following nucleotide sequence:
Hybridization Probe
5'-GGTCTCGTGACTGTGAAGCCATGTTACAACTA CTGCTCAAACATCATGAG-3' (SEQ ID NO:163).

In order to screen several libraries for a source of a full-length clone, DNA from the libraries was screened by PCR amplification with the PCR primer pair identified above. A positive library was then used to isolate clones encoding the PRO937 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO937 [herein designated as DNA56436-1448] (SEQ ID NO:159) and the derived protein sequence for PRO937.

The entire nucleotide sequence of DNA56436-1448 is shown in FIG. 96 (SEQ ID NO:159). It contains a single open reading frame having an apparent translational initiation site at nucleotide positions 499–501 and ending at the stop codon found at nucleotide positions 2167–2169 (FIG. 96, SEQ ID NO:159). The predicted polypeptide precursor is 556 amino acids long, has a calculated molecular weight of approximately 62,412 daltons and an estimated pI of approximately 6.62. Analysis of the full-length PRO937 sequence shown in FIG. 97 (SEQ ID NO:160) evidences the presence of the following features: signal peptide at about amino acids 1–22; ATP/GTP-binding site motif A (P-loop) at about amino acids 515–523; a potential N-glycosylation site at about amino acids 514–517; and sites of glypican homology at about amino acids 54–74, 106–156, 238–279, 309–345, 423–459, and 468–505.

Clone DNA56436-1448 has been deposited with ATCC on May 27, 1998, and is assigned ATCC deposit no. 209902.

Analysis of the amino acid sequence of the full-length PRO937 polypeptide suggests that it possesses significant sequence similarity to glypican proteins, thereby indicating that PRO937 may be a novel glypican protein. More specifically, an analysis of the Dayhoff database (version 35.45 SwissProt 35) evidenced significant homology between the PRO937 amino acid sequence and the following Dayhoff sequences: GPCK_MOUSE, GPC2_RAT, GPC5_HUMAN, GPC3_HUMAN, P_R30168, CEC03H12_2, GEN13820, HS119E23_1, HDAC_DROME, and AF017637_1.

Example 41

Isolation of cDNA Clones Encoding Human PRO842

Use of the signal sequence algorithm described in Example 3 above allowed identification of a single Incyte EST cluster sequence designated herein as Incyte EST cluster sequence no. 69572. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA54230.

In light of an observed sequence homology between the consensus sequence and an EST sequence encompassed within the Merck EST clone no. AA477092, the Merck EST clone AA477092 was purchased and the cDNA insert was obtained and sequenced. It was found that this insert encoded a full-length protein. The sequence of this cDNA insert is shown in FIG. 98 and is herein designated as DNA56855-1447.

The full length clone shown in FIG. 98 contained a single open reading frame with an apparent translational initiation site at nucleotide positions 153–155 and ending at the stop codon found at nucleotide positions 510–512 (FIG. 98; SEQ ID NO:164). The predicted polypeptide precursor (FIG. 99, SEQ ID NO:165) is 119 amino acids long. PRO842 has a calculated molecular weight of approximately 13,819 Daltons and an estimated pI of approximately 11.16. Other features of PRO842 include a signal peptide at about amino acids 1–22, a potential protein kinase C phosphorylation site at about amino acids 39–41 and two potential N-myristoylation sites at about amino acids 27–32 and about amino acids 46–51.

An analysis of the Dayhoff database (version 35.45 SwissProt 35), using a WU-BLAST-2 sequence alignment analysis of the full-length sequence shown in FIG. 98 (SEQ ID NO:164), evidenced some homology between the PRO842 amino acid sequence and the following Dayhoff sequences: CEZK131_11, P_R80843, RAT5HT2X_1, S81882_1, A60912, MCU60315_137MC137L, U93422_1, p_P91996, U93462_1, and ZN18_HUMAN.

Clone DNA56855-1447 was deposited with the ATCC on Jun. 23, 1998, and is assigned ATCC deposit no. 203004.

Example 42

Isolation of cDNA Clones Encoding Human PRO839

Use of the signal sequence algorithm described in Example 3 above allowed identification of an EST cluster sequence from the Incyte LIFESEQ® database, designated Incyte EST Cluster No. 24479. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55709.

In light of an observed sequence homology between the DNA55709 consensus sequence and an EST sequence encompassed within the Merck EST clone no. 754525, the Merck EST clone 754525 was purchased and the cDNA insert was obtained and sequenced. It was found that this insert encoded a full-length protein. The sequence of this cDNA insert is shown in FIG. 100 and is herein designated as DNA56859-1445.

The full length clone shown in FIG. 100 contained a single open reading frame with an apparent translational initiation site at nucleotide positions 2–4 and ending at the stop codon found at nucleotide positions 263–265 (FIG. 100; SEQ ID NO:166). The predicted polypeptide precursor (FIG. 101, SEQ ID NO:167) is 87 amino acids long. PRO839 has a calculated molecular weight of approximately 9,719 Daltons and an estimated pI of approximately 4.67. Other features of PRO839 include a signal peptide at about amino acids 1–23, potential protein kinase C phosphorylation sites at about amino acids 37–39 and about amino acids 85–87, a potential casein kinase II phosphorylation site at about amino acids 37–40, sequence identity with ribonucleotide reductase large subunit protein at about amino acids 50–60, and sequence identity with eukaryotic RNA-binding region RNP-1 proteins at about amino acids 70–79.

An analysis of the Dayhoff database (version 35.45 SwissProt 35), using a WU-BLAST-2 sequence alignment analysis of the full-length sequence shown in FIG. 101 (SEQ ID NO:167), evidenced some homology between the PRO839 amino acid sequence and the following Dayhoff sequences: CD14_MOUSE, XPR6_YARLI, HS714385_1, S49783, BB19_RABIT, GVPH-HALME, AB003135_1, P_R85453, LUU27081_2, and TP2B_MOUSE.

Clone DNA56859-1445 was deposited with the ATCC on Jun. 23, 1998, and is assigned ATCC deposit no.209019.

Example 43

Isolation of cDNA Clones Encoding Human PRO1180

Use of the signal sequence algorithm described in Example 3 above allowed identification of a single Incyte EST cluster sequence (Incyte EST cluster sequence no. 14732). The Incyte EST cluster sequence no. 14732 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology*

266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55711.

In light of an observed sequence homology between the DNA55711 consensus sequence and an EST sequence encompassed within the Merck EST clone no. T60981, the Merck EST clone T60981 was purchased and the cDNA insert was obtained and sequenced. It was found that this insert encoded a full-length protein. The sequence of this cDNA insert is shown in FIG. 102 and is herein designated DNA56860-1510.

The full length clone shown in FIG. 102 contained a single open reading frame with an apparent translational initiation site at nucleotide positions 78–80 and ending at the stop codon found at nucleotide positions 909–911 (FIG. 102; SEQ ID NO:168) The predicted polypeptide precursor is 277 amino acids long, has a calculated molecular weight of approximately 31,416 daltons and an estimated pI of approximately 8.88. Analysis of the full-length PRO1180 sequence shown in FIG. 103 (SEQ ID NO:169) evidences the presence of the following: a signal peptide from about amino acid 1 to about amino acid 23, a leucine zipper pattern sequence from about amino acid 10 to about amino acid 31, and potential N-myristolation sited from about amino acid 64 to about amino acid 69, from about amino acid 78 to about amino acid 83, from about amino acid 80 to about amino acid 85, from about amino acid 91 to about amino acid 96 and from about amino acid 201 to about amino acid 206. Clone DNA56860-1510 has been deposited with the ATCC on Jun. 9, 1998 and is assigned ATCC deposit no. 209952.

Analysis of the amino acid sequence of the full-length PRO1180 polypeptide suggests that it possesses sequence similarity to the methyltransferase family of proteins. More specifically, an analysis of the Dayhoff database (version 35.45 SwissProt 35) evidenced some degree of homology between the PRO1180 amino acid sequence and the following Dayhoff sequences, MTCI65_14, D69267, YH09_YEAST, BIOC_SERMA, ATAC00448415T1D16.16, SHGCPIR_18, SPBC3B9_4, AB009504_14, P_W17977 and A69952.

Example 44

Isolation of cDNA Clones Encoding Human PRO1134

Use of the signal sequence algorithm described in Example 3 above allowed identification of an EST cluster sequence from the Incyte database, designated 7511. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55725. Two proprietary Genentech EST sequences were employed in the assembly and are shown in FIG. 106 (SEQ ID NO:172) and FIG. 107 (SEQ ID NO:173).

In light of an observed sequence homology between the DNA55725 consensus sequence and an EST sequence encompassed within the Merck EST clone no. H94897, the Merck EST clone H94897 was purchased and the cDNA insert was obtained and sequenced. It was found that this insert encoded a full-length protein. The sequence of this cDNA insert is shown in FIG. 106 and is herein designated as DNA56865-1491.

Clone DNA56865-1491 contains a single open reading frame with an apparent translational initiation site at nucleotide positions 153–155 and ending at the stop codon at nucleotide positions 1266–1268 (FIG. 104). The predicted polypeptide precursor is 371 amino acids long (FIG. 105). The full-length PRO1134 protein shown in FIG. 105 has an estimated molecular weight of about 41,935 daltons and a pI of about 9.58. Analysis of the full-length PRO1134 sequence shown in FIG. 105 (SEQ ID NO:171) evidences the presence of the following: a signal peptide from about amino acid 1 to about amino acid 23, potential N-glycosylation sites from about amino acid 103 to about amino acid 106, from about amino acid 249 to about amino acid 252 and from about amino acid 257 to about amino acid 260, and an amino acid block having homology to tyrosinase CuA-binding region proteins from about amino acid 280 to about amino acid 306. Clone DNA56865-1491 has been deposited with ATCC on Jun. 23, 1998 and is assigned ATCC deposit no. 203022.

An analysis of the Dayhoff database (version 35.45 SwissProt 35), using a WU-BLAST-2 sequence alignment analysis of the full-length sequence shown in FIG. 105 (SEQ ID NO:171), evidenced significant homology between the PRO1134 amino acid sequence and the following Dayhoff sequences: F20P5_18, AC002396_10, S47847, C64146, GSPA_BACSU, P_W10564, RFAI_ECOLI, Y258_HAEIN, RFAJ_SALTY and P_R32985.

Example 45

Isolation of cDNA Clones Encoding Human PRO830

Use of the signal sequence algorithm described in Example 3 above allowed identification of an EST cluster sequence from the Incytedatabase, designated 20251. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55733.

In light of an observed sequence homology between the DNA55733 consensus sequence and an EST sequence encompassed within the Merck EST clone no. H78534, the Merck EST clone H78534 was purchased and the cDNA insert was obtained and sequenced. It was found that this insert encoded a full-length protein. The sequence of this cDNA insert is shown in FIG. 108 and is herein designated as DNA56866-1342.

Clone DNA56866-1342 contains a single open reading frame with an apparent translational initiation site at nucleotide positions 154–156 and ending at the stop codon at nucleotide positions 415–417 (FIG. 108). The predicted polypeptide precursor is 87 amino acids long (FIG. 109). The full-length PRO830 protein shown in FIG. 109 has an estimated molecular weight of about 9,272 daltons and a pI of about 9.19. Analysis of the full-length PRO830 sequence shown in FIG. 109 (SEQ ID NO:175) evidences the presence of the following: a signal peptide from about amino acid 1 to about amino acid 33, potential N-myristoylation sites from about amino acid 2 to about amino acid 7 and from about amino acid 8 to about amino acid 13 and a thioredoxin family of proteins homology block from about amino acid 23 to about amino acid 39. Clone UNQ470 (DNA56866-1342) has been deposited with ATCC on Jun. 22, 1998 and is assigned ATCC deposit no. 203023.

An analysis of the Dayhoff database (version 35.45 SwissProt 35), using a WU-BLAST-2 sequence alignment analysis of the full-length sequence shown in FIG. 109 (SEQ ID NO:175), evidenced significant homology between the PRO830 amino acid sequence and the following Dayhoff sequences: HSU88154_1, HSU88153_1, SAPKSGENE_1, HPU31791_5, GGCNOT2_1, CPU91421_1, CHKESTPC09_1, PQ0769, U97553_79 and B60095.

Example 46

Isolation of cDNA Clones Encoding Human PRO1115

Use of the signal sequence algorithm described in Example 3 above allowed identification of an EST cluster sequence from the LIFESEQ® database, designated Incyte EST cluster sequence no. 165008. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55726.

In light of an observed sequence homology between the DNA55726 consensus sequence and an EST sequence encompassed within the Merck EST clone no. R75784, the Merck EST clone R75784 was purchased and the cDNA insert was obtained and sequenced. It was found that this insert encoded a full-length protein. The sequence of this cDNA insert is shown in FIG. 111 and is herein designated as DNA56868-1478.

The full length clone shown in FIG. 110 contained a single open reading frame with an apparent translational initiation site at nucleotide positions 189–191 and ending at the stop codon found at nucleotide positions 1524–1526 (FIG. 110; SEQ ID NO:176). The predicted polypeptide precursor (FIG. 111, SEQ ID NO:177) is 445 amino acids long. PRO1115 has a calculated molecular weight of approximately 50,533 Daltons and an estimated pI of approximately 8.26. Additional features include a signal peptide at about amino acids 1–20; potential N-glycosylation sites at about amino acids 204–207, 295–298, and 313–316; and putative transmembrane domains at about amino acids 35–54, 75–97, 126–146, 185–204, 333–350, and 353–371.

An analysis of the Dayhoff database (version 35.45 SwissProt 35), using a WU-BLAST-2 sequence alignment analysis of the full-length sequence shown in FIG. 111 (SEQ ID NO:177), evidenced some amino acid sequence identity between the PRO1115 amino acid sequence and the following Dayhoff sequences: AF053947_79, S73698, CEC47A10_4, CCOMTNDS5G_1, HS4LMP2AC_1, LMP2_EBV, PA24_MOUSE, HCU33331_7, P_W05508, and AF002273_1.

Clone DNA56868-1478 was deposited with the ATCC on Jun. 23, 1998 and is assigned ATCC deposit no. 203024.

Example 47

Isolation of cDNA Clones Encoding Human PRO1277

A consensus DNA sequence was assembled relative to other ESTs using repeated cycles of BLAST and the program "phrap" as described in Example 1 above. One or more of the ESTs from the assembly was derived from diseased coronary artery tissue. The consensus sequence obtained is designated herein as "DNA49434".

In light of an observed sequence homology between the DNA49434 consensus sequence and an EST sequence encompassed within the Incyte EST clone no. 3042605, the Incyte EST clone 3042605 was purchased and the cDNA insert was obtained and sequenced. It was found that this insert encoded a full-length protein. The sequence of this cDNA insert is shown in FIG. 112 (SEQ ID NO:178).

Clone DNA56869-1545 contains a single open reading frame with an apparent translational initiation site at nucleotide positions 188–190, and an apparent stop codon at nucleotide positions 2222–2224 (FIG. 112). The predicted polypeptide precursor is 678 amino acids long (FIG. 113). The full-length PRO1277 protein shown in FIG. 113 has an estimated molecular weight of about 73,930 daltons and a pI of about 9.48. Additional features include a signal peptide at about amino acids 1–26; a transmembrane domain at about amino acids 181–200, and potential N-glycosylation sites at about amino acids 390–393 and 520–523.

An analysis of the Dayhoff database (version 35.45 SwissProt 35), using a WU-BLAST-2 sequence alignment analysis of the full-length sequence shown in FIG. 113 (SEQ ID NO:179), revealed significant homology between the PRO1277 amino acid sequence and Dayhoff sequence no AF012252_1. Homology was also found between the PRO1277 amino acid sequence and the following Dayhoff sequences: AF006740_1, CA36_HUMAN, HSU1_1, HUMCOL7A1X_1, CA17_HUMAN, MMZ78163_1, CAMA_CHICK, HSU69263_1, YNX3_CAEEL, and MmRNAM3_1.

Clone DNA56869-1545 has been deposited with ATCC and is assigned ATCC deposit no. 203161.

Example 48

Isolation of cDNA Clones Encoding Human PRO1135

A consensus DNA sequence was assembled relative to other EST sequences using phrap as described in Example 1 above. This consensus sequence is herein designated DNA52767. Based on the DNA52767 consensus sequence, oligonucleotides were synthesized: 1) to identify by PCR a cDNA library that contained the sequence of interest, and 2) for use as probes to isolate a clone of the full-length coding sequence for PRO1135.

In order to screen several libraries for a source of a full-length clone, DNA from the libraries was screened by PCR amplification with PCR primer pairs prepared based upon the DNA52767 sequence. A positive library was then used to isolate clones encoding the PRO1135 gene using the probe oligonucleotide and one of the PCR primers. RNA for construction of the cDNA libraries was isolated from human coronary artery smooth muscle tissue (LIB309). The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or PRKD; pRK5B is a precursor of pRK5D that does not contain the SfiI site; see, Holmes et al., *Science* 253:1278–1280 (1991)) in the unique XhoI and NotI sites.

DNA sequencing of the clones isolated as described above gave the full-length DNA sequence for PRO1135 [herein designated as DNA56870-1492] (SEQ ID NO:180) and the derived protein sequence for PRO1135.

The entire nucleotide sequence of DNA56870-1492 is shown in FIG. 114 (SEQ ID NO:180). Clone DNA56870-1492 contains a single open reading frame with an apparent translational initiation site at nucleotide positions 62–64 and ending at the stop codon at nucleotide positions 1685–1687 (FIG. 114). The predicted polypeptide precursor is 541 amino acids long (FIG. 115). The full-length PRO1135 protein shown in FIG. 115 has an estimated molecular weight of about 60,335 daltons and a pI of about 5.26. Analysis of the full-length PRO1135 sequence shown in FIG. 115 (SEQ ID NO:181) evidences the presence of the following: a signal peptide from about amino acid 1 to about amino acid 21, potential N-glycosylation sited from about amino acid 53 to about amino acid 56, from about amino acid 75 to about amino acid 78, from about amino acid 252 to about amino acid 255 and from about amino acid 413 to about amino acid 416 and an amino acid block having homology to glycosyl hydrolase family 35 proteins from about amino acid 399 to about amino acid 414. Clone DNA56870-1492 has been deposited with ATCC on Jun. 2, 1998 and is assigned ATCC deposit no. 209925.

Analysis of the amino acid sequence of the full-length PRO1135 polypeptide suggests that it possesses significant sequence similarity to the alpha 1,2-mannosidase protein, thereby indicating that PRO1135 may be a novel mannosidase. More specifically, an analysis of the Dayhoff database (version 35.45 SwissProt 35) evidenced significant homology between the PRO1135 amino acid sequence and the following Dayhoff sequences, DMC86E4__5, D86967__1, SPAC23A1__4, YH04__YEAST, B54408, SSMAN9MAN__1, CEZC410__4, S61631 and MSU14190__1.

Example 49

Isolation of cDNA Clones Encoding Human PRO1114

A cDNA sequence isolated in the amylase screen described in Example 2 above was found, by the WU-BLAST-2 sequence alignment computer program, to have certain sequence identity to other known interferon receptors. This cDNA sequence is herein designated DNA48466 and is shown in FIG. 118 (SEQ ID NO:184). Based on the sequence identity, probes were generated from the sequence of the DNA48466 molecule and used to screen a human breast carcinoma library (LIB135) prepared as described in paragraph 1 of Example 2 above. The cloning vector was pRK5B (pRK5B is a precursor of pRK5D that does not contain the SfiI site; see, Holmes et al., *Science*, 253:1278–1280 (1991)), and the cDNA size cut was less than 2800 bp.

The oligonucleotide probes employed were as follows:

```
forward PCR primer    5'-AGGCTTCGCTGCGACTAGACCTC-3'              (SEQ ID NO:185)
reverse PCR primer    5'-CCAGGTCGGGTAAGGATGGTTGAG-3'             (SEQ ID NO:186)
hybridization probe   5'-TTTCTACGCATTGATTCCATGTTTGCT             (SEQ ID NO:187)
                         CACAGATGAAGTGGCCATTCTGC-3'
```

A full length clone was identified that contained a single open reading frame with an apparent translational initiation site at nucleotide positions 250–252, and a stop signal at nucleotide positions 1183–1185 (FIG. 116, SEQ ID NO:182). The predicted polypeptide precursor is 311 amino acids long, has a calculated molecular weight of approximately 35,076 daltons and an estimated pI of approximately 5.04. Analysis of the full-length PRO1114 interferon receptor sequence shown in FIG. 117 (SEQ ID NO:183) evidences the presence of the following: a signal peptide from about amino acid 1 to about amino acid 29, a transmembrane domain from about amino acid 230 to about amino acid 255, potential N-glycosylation sites from about amino acid 40 to about amino acid 43 and from about amino acid 134 to about amino acid 137, an amino acid sequence block having homology to tissue factor proteins from about amino acid 92 to about amino acid 119 and an amino acid sequence block having homology to integrin alpha chain proteins from about amino acid 232 to about amino acid 262. Clone DNA57033-1403 has been deposited with ATCC on May 27, 1998 and is assigned ATCC deposit no. 209905.

An analysis of the Dayhoff database (version 35.45 SwissProt 35), using a WU-BLAST-2 sequence alignment analysis of the full-length sequence shown in FIG. 117 (SEQ ID NO:183), evidenced significant homology between the PRO1114 interferon receptor amino acid sequence and the following Dayhoff sequences: G01418, INR1__MOUSE, P__R71035, INGS__HUMAN, A26595__1, A26593__1, I56215 and TF__HUMAN.

Example 50

Isolation of cDNA Clones Encoding Human PRO828

A consensus DNA sequence was identified using the method described in Example 1 above. This consensus sequence is herein designated DNA35717. Based on the DNA35717 consensus sequence, oligonucleotides were synthesized: 1) to identify by PCR a cDNA library that contained the sequence of interest, and 2) for use as probes to isolate a clone of the full-length coding sequence for PRO828.

PCR primers (forward and reverse) were synthesized:

```
forward PCR primer  5'-GCAGGACTTCTACGACTTCAAGGC-3'  (SEQ ID NO:190); and
reverse PCR primer  5'-AGTCTGGGCCAGGTACTTGAAGGC-3'  (SEQ ID NO:191).
```

Additionally, a synthetic oligonucleotide hybridization probe was constructed from the consensus DNA35717 sequence which had the following nucleotide sequence:
Hybridization Probe
5'-CAACATCCGGGGCAAACTGGTGTCGCTGGAGA AGTACCGCGGATCGGTGT-3' (SEQ ID NO:192)

In order to screen several libraries for a source of a full-length clone, DNA from the libraries was screened by PCR amplification with the PCR primer pair identified above. A positive library was then used to isolate clones encoding the PRO828 gene using the probe oligonucleotide and one of the PCR primers. RNA for construction of the cDNA libraries was isolated from human fetal lung tissue (LIB25).

DNA sequencing of the clones isolated as described above gave the full-length DNA sequence for PRO828 [herein designated as DNA57037-1444] (SEQ ID NO:188) and the derived protein sequence for PRO828.

The entire nucleotide sequence of DNA57037-1444 is shown in FIG. 119 (SEQ ID NO:188). Clone DNA57037-1444 contains a single open reading frame with an apparent translational initiation site at nucleotide positions 34–36 and ending at the stop codon at nucleotide positions 595–597 (FIG. 119). The predicted polypeptide precursor is 187 amino acids long (FIG. 120). The full-length PRO828 protein shown in FIG. 120 has an estimated molecular weight of about 20,996 daltons and a pI of about 8.62. Analysis of the full-length PRO828 sequence shown in FIG. 120 (SEQ ID NO:189) evidences the presence of the following: a signal peptide at about amino acids 1–21; sequences identity to glutathione peroxidases signature 2 at about amino acids 82–89; sequence identity to glutathione peroxidases selenocysteine proteins at about amino acids 35–60, 63–100, 107–134, and 138–159. Clone DNA57037-1444 has been deposited with ATCC on May 27, 1998, and is assigned ATCC deposit no. 209903.

Analysis of the amino acid sequence of the full-length PRO828 polypeptide suggests that it possesses significant sequence similarity to glutathione peroxidases, thereby indicating that PRO828 may be a novel peroxidase enzyme. More specifically, an analysis of the Dayhoff database (version 35.45 SwissProt 35) evidenced sequence identity between the PRO828 amino acid sequence and the following Dayhoff sequences: AF053311_1, CELT09A12_2, AC004151_3, BTUE_ECOLI, CER05H10_3, P_P80918, PWU88907_1, and P_W22308.

Example 51

Isolation of cDNA Clones Encoding Human PRO1009

A cDNA clone (DNA57129-1413) encoding a native human PRO1009 polypeptide was identified by the use of a yeast screen, in a human SK-Lu-1 adenocarcinoma cell line cDNA library that preferentially represents the 5' ends of the primary cDNA clones. First SEQ ID NO:195 (FIG. 123) was identified, which was extended by alignments to other EST sequences to form a consensus sequence. Oligonucleotide probes based upon the consensus sequence were synthesized and used to screen the cDNA library which gave rise to the full-length DNA57129-1413 clone.

The full length DNA57129-1413 clone shown in FIG. 121 contained a single open reading frame with an apparent translational initiation site at nucleotide positions 41–43 and ending at the stop codon found at nucleotide positions 1886–1888 (FIG. 121; SEQ ID NO:193). The predicted polypeptide precursor (FIG. 122, SEQ ID NO:194) is 615 amino acids long. FIG. 122 also shows the approximate locations of the signal sequence, transmembrane domains, myristoylation sites, a glycosylation site and an AMP-binding domain. PRO1009 has a calculated molecular weight of approximately 68,125 daltons and an estimated pI of approximately 7.82. Clone DNA57129-1413 has been deposited with ATCC and is assigned ATCC deposit no. 209977. It is understood that the deposited clone has the actual and correct sequence and that the representations herein may have minor, normal sequencing errors.

Based on a WU-BLAST-2 sequence alignment analysis (using the ALIGN computer program) of the full-length sequence, PRO1009 shows amino acid sequence identity to at least the following proteins which were designated in a Dayhoff database as follows: F69893, CEF28F8_2, BSY13917_7, BSY13917_7, D69187, D69649, XCRPFB_1, E64928, YDID_ECOLI, BNACSF8_1 and RPU753632.

Example 52

Isolation of cDNA Clones Encoding Human PRO1007

A consensus DNA sequence was assembled relative to other EST sequences using phrap as described in Example 1 above. This consensus sequence is herein designated as DNA40671.

In light of an observed sequence homology between the DNA40671 consensus sequence and an EST sequence encompassed within the Merck EST clone no. T70513, the Merck EST clone T70513 was purchased and the cDNA insert was obtained and sequenced. It was found that this insert encoded a full-length protein. The sequence of this cDNA insert is shown in FIG. 124.

The entire nucleotide sequence of DNA57690-1374 is shown in FIG. 124 (SEQ ID NO:196). Clone DNA57690-1374 contains a single open reading frame with an apparent translational initiation site at nucleotide positions 16–18 and ending at the stop codon at nucleotide positions 1054–1056 (FIG. 124). The predicted polypeptide precursor is 346 amino acids long (FIG. 125). The full-length PRO1007 protein shown in FIG. 125 has an estimated molecular weight of about 35,971 daltons and a pI of about 8.17. Clone DNA57690-1374 has been deposited with the ATCC on Jun. 9, 1998. Regarding the sequence, it is understood that the deposited clone contains the actual sequence, and the sequences provided herein are based on known sequencing techniques. The representative figures herein show the representative numbering.

Analysis of the amino acid sequence of the full-length PRO1007 polypeptide suggests that portions of it possess sequence identity to MAGPIAP, thereby indicating that PRO1007 may be a novel member of the family to which MAGPIAP belongs.

Still analyzing the amino acid sequence of SEQ ID NO:197, the putative signal peptide is at about amino acids 1–30 of SEQ ID NO:197. The transmembrane domain is at amino acids 325–346 of SEQ ID NO:197. N-glycosylation sites are at about amino acids 118–121, 129–132, 163–166, 176–179, 183–186 and 227–130 of SEQ ID NO:197. Ly-6/u-Par domain protein homology is at about amino acids 17–36 and 209–222 of SEQ ID NO:197. The corresponding nucleotides of the amino acids presented herein can be routinely determined given the sequences provided herein.

Example 53

Isolation of cDNA Clones Encoding Human PRO1056

Use of the signal sequence algorithm described in Example 3 above allowed identification of an EST cluster sequence from the Incyte database, designated herein as 6425. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55736.

In light of an observed sequence homology between the DNA55736 consensus sequence and an EST sequence encompassed within the Merck EST clone no. R88049, the Merck EST clone R88049 was purchased and the cDNA insert was obtained and sequenced. It was found that this insert encoded a full-length protein. The sequence of this cDNA insert is shown in FIG. 126 and is herein designated as DNA57693-1424.

Clone DNA57693-1424 contains a single open reading frame with an apparent translational initiation site at nucleotide positions 56–58 and ending at the stop codon at nucleotide positions 416–418 (FIG. 126). The predicted polypeptide precursor is 120 amino acids long (FIG. 127). The full-length PRO1056 protein shown in FIG. 127 has an estimated molecular weight of about 13,345 daltons and a pI of about 5.18. Analysis of the full-length PRO1056 sequence shown in FIG. 127 (SEQ ID NO:199) evidences the presence of the following: a signal peptide from about amino acid 1 to about amino acid 18, a transmembrane domain from about amino acid 39 to about amino acid 58, a potential N-glycosylation site from about amino acid 86 to about amino acid 89, protein kinase C phosphorylation sites from about amino acid 36 to about amino acid 38 and from about amino acid 58 to about amino acid 60, a tyrosine kinase phosphorylation site from about amino acid 25 to about amino acid 32 and an amino acid sequence block having homology to channel forming colicin proteins from about amino acid 24 to about amino acid 56. Clone DNA57693-1424 has been deposited with ATCC on Jun. 23, 1998 and is assigned ATCC deposit no. 203008.

An analysis of the Dayhoff database (version 35.45 Swis-sProt 35), using a WU-BLAST-2 sequence alignment analysis of the full-length sequence shown in FIG. 127 (SEQ ID NO:199), evidenced significant homology between the PRO1056 amino acid sequence and the following Dayhoff sequences: PLM_HUMAN, A40533, ATNG_HUMAN, A55571, ATNG_SHEEP, S31524, GEN13025, RIC_MOUSE, A48678 and A10871_1.

Example 54

Isolation of cDNA Clones Encoding Human PRO826

Use of the signal sequence algorithm described in Example 3 above allowed identification of an EST cluster sequence from the Incyte database, designated 47283. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56000.

In light of an observed sequence homology between the DNA56000 consensus sequence and an EST sequence encompassed within the Merck EST clone no. W69233, the Merck EST clone W69233 was purchased and the cDNA insert was obtained and sequenced. It was found that this insert encoded a full-length protein. The sequence of this cDNA insert is shown in FIG. 128 and is herein designated as DNA57694-1341.

Clone DNA57694-1341 contains a single open reading frame with an apparent translational initiation site at nucleotide positions 13–15 and ending at the stop codon at nucleotide positions 310–312 (FIG. 128). The predicted polypeptide precursor is 99 amino acids long (FIG. 129). The full-length PRO826 protein shown in FIG. 129 has an estimated molecular weight of about 11,050 daltons and a pI of about 7.47. Analysis of the full-length PRO826 sequence shown in FIG. 129 (SEQ ID NO:201) evidences the presence of the following: a signal peptide from about amino acid 1 to about amino acid 22, potential N-myristoylation sites from about amino acid 22 to about amino acid 27 and from about amino acid 90 to about amino acid 95 and an amino acid sequence block having homology to peroxidase from about amino acid 16 to about amino acid 48. Clone DNA57694-1341 has been deposited with ATCC on Jun. 22, 1998 and is assigned ATCC deposit no. 203017.

An analysis of the Dayhoff database (version 35.45 Swis-sProt 35), using a WU-BLAST-2 sequence alignment analysis of the full-length sequence shown in FIG. 129 (SEQ ID NO:201), evidenced significant homology between the PRO826 amino acid sequence and the following Dayhoff sequences: CCU12315_1, SCU96108_6, CELF39F10_4 and HELT_HELHO.

Example 55

Isolation of cDNA Clones Encoding Human PRO819

Use of the signal sequence algorithm described in Example 3 above allowed identification of an EST cluster sequence from the Incyte database, designated 49605. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56015.

In light of an observed sequence homology between the DNA56015 consensus sequence and an EST sequence encompassed within the Merck EST clone no. H65785, the Merck EST clone H65785 was purchased and the cDNA insert was obtained and sequenced. It was found that this insert encoded a full-length protein. The sequence of this cDNA insert is shown in FIG. 130 and is herein designated as DNA57695-1340.

Clone DNA57695-1340 contains a single open reading frame with an apparent translational initiation site at nucleotide positions 46–48 and ending at the stop codon at nucleotide positions 202–204 (FIG. 130). The predicted polypeptide precursor is 52 amino acids long (FIG. 131). The full-length PRO819 protein shown in FIG. 131 has an estimated molecular weight of about 5,216 daltons and a pI of about 4.67. Analysis of the full-length PRO819 sequence shown in FIG. 131 (SEQ ID NO:203) evidences the presence of the following: a signal peptide from about amino acid 1 to about amino acid 24, a potential N-myristoylation site from about amino acid 2 to about amino acid 7 and a region having homology to immunoglobulin light chain from about amino acid 5 to about amino acid 33. Clone DNA57695-1340 has been deposited with ATCC on Jun. 23, 1998 and is assigned ATCC deposit no. 203006.

An analysis of the Dayhoff database (version 35.45 SwissProt 35), using a WU-BLAST2 sequence alignment analysis of the full-length sequence shown in FIG. 131 (SEQ ID NO:203), evidenced significant homology between the PRO819 amino acid sequence and the following Dayhoff sequences: HSU03899_1, HUMIGLITEB_1, VG28_HSVSA, AF031522_1, PAD1_YEAST and AF045484_1.

Example 56

Isolation of cDNA Clones Encoding Human PRO1006

An initial candidate sequence from Incyte cluster sequence no. 45748 was identified using the signal algorithm process described in Example 3 above. This sequence was then aligned with a variety of public and Incyte EST sequences and a consensus sequence designated herein as DNA56036 was derived therefrom.

In light of an observed sequence homology between the DNA56036 consensus sequence and an EST sequence encompassed within the Merck EST clone no. 489737, the Merck EST clone 489737 was purchased and the cDNA insert was obtained and sequenced. It was found that this insert encoded a full-length protein. The sequence of this cDNA insert is shown in FIG. 132.

The entire nucleotide sequence of DNA57699-1412 is shown in FIG. 132 (SEQ ID NO:204). Clone DNA57699-1412 contains a single open reading frame with an apparent translational initiation site at nucleotide positions 28–30 and ending at the stop codon at nucleotide positions 1204–1206 (FIG. 132). The predicted polypeptide precursor is 392 amino acids long (FIG. 133). The full-length PRO1006 protein shown in FIG. 133 has an estimated molecular weight of about 46,189 daltons and a pI of about 9.04. Clone DNA57699-1412 has been deposited with the ATCC. Regarding the sequence, it is understood that the deposited clone contains the correct sequence, and the sequences provided herein are based on known sequencing techniques.

Analyzing the amino acid sequence of SEQ ID NO:205, the putative signal peptide is at about amino acids 1–23 of SEQ ID NO:205. The N-glycosylation sites are at about amino acids 40–43, 53–56, 204–207 and 373–376 of SEQ ID NO:205. An N-myristoylation site is at about amino acids 273–278 of SEQ ID NO:205. The corresponding nucleotides of these amino acid regions and others can be routinely determined given the sequences provided herein.

Example 57

Isolation of cDNA Clones Encoding Human PRO1112

Use of the signal sequence algorithm described in Example 3 above allowed identification of a specific EST cluster sequence. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56018.

In light of an observed sequence homology between the DNA56018 consensus sequence and an EST sequence encompassed within the Merck EST clone no. AA223546, the Merck EST clone AA223546 was purchased and the cDNA insert was obtained and sequenced. It was found that this insert encoded a full-length protein. The sequence of this cDNA insert is shown in FIG. 134 and is herein designated as DNA57702-1476.

The entire nucleotide sequence of DNA57702-1476 is shown in FIG. 134 (SEQ ID NO:206). Clone DNA57702-1476 contains a single open reading frame with an apparent translational initiation site at nucleotide positions 20–22 and ending at the stop codon at nucleotide positions 806–808 of SEQ ID NO:206 (FIG. 134). The predicted polypeptide precursor is 262 amino acids long (FIG. 135). The full-length PRO112 protein shown in FIG. 135 has an estimated molecular weight of about 29,379 daltons and a pI of about 8.93. FIG. 135 also shows the approximate locations of the signal peptide and transmembrane domains. Clone DNA57702-1476 has been deposited with the ATCC on Jun. 9, 1998. It is understood that the deposited clone has the actual nucleic acid sequence and that the sequences provided herein are based on known sequencing techniques.

Analysis of the amino acid sequence of the full-length PRO1112 polypeptide suggests that it possesses some sequence similarity to other proteins. More specifically, an analysis of the Dayhoff database (version 35.45 SwissProt 35) evidenced some sequence identity between the PRO112 amino acid sequence and at least the following Dayhoff sequences, MTY20B11_13 (a *mycobacterium tuberculosis* peptide), F64471, AE000690_6, XLU16364_1, E43259 (H+-transporting ATP synthase) and PIGSLADRXE_1 (MHC class II histocompatibility antigen).

Example 58

Isolation of cDNA Clones Encoding Human PRO1074

Use of the signal sequence algorithm described in Example 3 above allowed identification of a single Incyte EST cluster sequence (Incyte cluster sequence No. 42586). This cluster sequence was then compared to a variety of expressed sequence tag (EST) databases which included public EST databases (e.g., GenBank) and a proprietary EST DNA database (LIFESE™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained therefrom is herein designated DNA56251.

In light of an observed sequence homology between the DNA56251 consensus sequence and an EST sequence encompassed within the Merck EST clone no. AA081912, the Merck EST clone AA081912 was purchased and the cDNA insert was obtained and sequenced. It was found that this insert encoded a full-length protein. The sequence of this cDNA insert is shown in FIG. 136 and is the full-length DNA sequence for PRO1074. Clone DNA57704-1452 was deposited with the ATCC on Jun. 9, 1998, and is assigned ATCC deposit no. 209953.

The entire nucleotide sequence of DNA57704-1452 is shown in FIG. 136 (SEQ ID NO:208). Clone DNA57704-1452 contains a single open reading frame with an apparent translational initiation site at nucleotide positions 322–324 and ending at the stop codon at nucleotide positions 1315–1317 (FIG. 136). The predicted polypeptide precursor is 331 amino acids long (FIG. 137). The full-length PRO1074 protein shown in FIG. 137 has an estimated molecular weight of about 39,512 Daltons and a pI of about 8.03. Analysis of the full-length PRO1074 sequence shown in FIG. 137 (SEQ ID NO:209) evidences the presence of the following features: a transmembrane domain at about amino acids 20 to 39; potential N-glycosylation sites at about amino acids 72 to 75, 154 to 157, 198 to 201, 212 to 215, and 326 to 329; a glycosaminoglycan attachment site at about amino acids 239 to 242, and a Ly-6/u-PAR domain at about amino acids 23 to 36.

Analysis of the amino acid sequence of the full-length PRO1074 polypeptide suggests that it possesses significant sequence similarity to beta 1,3-galactosyltransferase, thereby indicating that PRO1074 may be a novel member of the galactosyltransferase family of proteins. Analysis of the amino acid sequence of the full-length PRO1074 polypeptide using the Dayhoff database (version 35.45 SwissProt 35) evidenced homology between the PRO1074 amino acid sequence and the following Dayhoff sequences: AF029792_1, P_R57433, DMU41449_1, AC000348_14, P_R47479, CET09F5_2, CEF14B6_4, CET15D65, CEC54C8_4, and CEE03H4_10.

Clone DNA57704-1452 was deposited with the ATCC on Jun. 9, 1998, and is assigned ATCC deposit no. 209953.

Example 59

Isolation of cDNA Clones Encoding Human PRO1005

Use of the signal sequence algorithm described in Example 3 above allowed identification of an EST cluster sequence from the LIFESEQ® database, Incyte cluster sequence no. 49243. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56380.

In light of an observed sequence homology between the DNA56380 consensus sequence and an EST sequence encompassed within the Merck EST clone no. AA256657, the Merck EST clone AA256657 was purchased and the cDNA insert was obtained and sequenced. It was found that this insert encoded a full-length protein. The sequence of this cDNA insert is shown in FIG. 138 and is herein designated as DNA57708-1411.

The full length clone shown in FIG. 138 contained a single open reading frame with an apparent translational initiation site at nucleotide positions 30–32 and ending at the stop codon found at nucleotide positions 585–587 (FIG. 138; SEQ ID NO:210). The predicted polypeptide precursor (FIG. 139, SEQ ID NO:211) is 185 amino acids long. PRO1005 has a calculated molecular weight of approximately 20,331 daltons and an estimated pI of approximately 5.85. Clone DNA57708-1411 was deposited with the ATCC Jun. 23, 1998, and is assigned ATCC deposit no. 203021.

An analysis of the Dayhoff database (version 35.45 SwissProt 35), using a WU-BLAST2 sequence alignment analysis of the full-length sequence shown in FIG. 139 (SEQ ID NO:211), evidenced some homology between the PRO1005 amino acid sequence and the following Dayhoff sequences: DDU07187_1, DDU87912_1, CELD1007_14, A42239, DDU42597_1, CYAG_DICDI, S50452, MRKC_KLEPN, P_R41998, and XYNA_RUMFL.

Example 60

Isolation of cDNA Clones Encoding Human PRO1073

An initial DNA sequence referred to herein as DNA55938 and shown in FIG. 142 (SEQ ID NO:214) was identified using a yeast screen, in a human SK-Lu-1 adenocarcinoma cell line cDNA library that preferentially represents the 5' ends of the primary cDNA clones. DNA55938 was then compared to ESTs from public databases (e.g., GenBank), and a proprietary EST database (LIFESEQ®, Incyte Pharmaceuticals, Palo Alto, Calif.), using the computer program BLAST or BLAST2 [Altschul et al., *Methods in Enzymology*, 266:460–480 (1996)]. The ESTs were clustered and assembled into a consensus DNA sequence using the computer program "phrap" (Phil Green, University of Washington, Seattle, Wash.). The consensus sequence obtained is designated herein as DNAS6411.

In light of an observed sequence homology between the DNA56411 consensus sequence and an EST sequence encompassed within the Merck EST clone no. H86027, the Merck EST clone H86027 was purchased and the cDNA insert was obtained and sequenced. It was found that this insert encoded a full-length protein. The sequence of this cDNA insert is shown in FIG. 140.

The full length DNA57710-1451 clone shown in FIG. 140 contained a single open reading frame with an apparent translational initiation site at nucleotide positions 345–347 and ending at the stop codon found at nucleotide positions 1242–1244 (FIG. 140; SEQ ID NO:212). The predicted polypeptide precursor (FIG. 141, SEQ ID NO:213) is 299 amino acids long. PRO1073 has a calculated molecular weight of approximately 34,689 daltons and an estimated pI of approximately 11.49. The PRO1073 polypeptide has the following additional features: a signal peptide at about amino acids 1–31, sequence identity to bZIP transcription factor basic domain signature at about amino acids, a potential N-glycosylation site at about amino acids 2–5, and sequence identity with protamine P1 proteins at about amino acids 158–183.

An analysis of the Dayhoff database (version 35.45 SwissProt 35), using a WU-BLAST-2 sequence alignment analysis of the full-length sequence shown in FIG. 141 (SEQ ID NO:213), revealed some sequence identity between the PRO1073 amino acid sequence and the following Dayhoff sequences: MMU37351_1, ATAC00250510T9J22.10, S59043, ENXNUPR_1, B47328, SR55_DROME, S26650, SON_HUMAN, VIT2_CHICK, and XLC4SRPRT_1.

Clone DNA57710-1451 was deposited with the ATCC on Jul. 1, 1998 and is assigned ATCC deposit no. 203048.

Example 61

Isolation of cDNA Clones Encoding Human PRO1152

A cDNA clone (DNA57711-1501) encoding a native human PRO1152 polypeptide was identified by employing a yeast screen, in a human infant brain cDNA library that preferentially represents the 5' ends of the primary cDNA clones. Specifically, a yeast screen was employed to identify a cDNA designated herein as DNA55807 (SEQ ID NO:217; see FIG. 145).

In light of an observed sequence homology between the DNA55807 sequence and an EST sequence encompassed within the Merck EST clone no. R56756, the Merck EST clone R56756 was purchased and the cDNA insert was obtained and sequenced. It was found that this insert encoded a full-length protein. The sequence of this cDNA insert is shown in FIG. 143.

The full-length DNA57711-1501 clone shown in FIG. 143 contains a single open reading frame with an apparent translational initiation site at nucleotide positions 58–60 and ending at the stop codon at nucleotide positions 1495–1497 (FIG. 143). The predicted polypeptide precursor is 479 amino acids long (FIG. 144). The full-length PRO1152 protein shown in FIG. 144 has an estimated molecular weight of about 53,602 daltons and a pI of about 8.82. Analysis of the full-length PRO1152 sequence shown in FIG. 144 (SEQ ID NO:216) evidences the presence of the following: a signal peptide from about amino acid 1 to about amino acid 28, transmembrane domains from about amino acid 133 to about amino acid 155, from about amino acid 168 to about amino acid 187, from about amino acid 229 to about amino acid 247, from about amino acid 264 to about amino acid 285, from about amino acid 309 to about amino acid 330, from about amino acid 371 to about amino acid 390 and from about amino acid 441 to about amino acid 464, potential N-glycosylation sites from about amino acid 34 to about amino acid 37 and from about amino acid 387 to about amino acid 390 and an amino acid sequence block having homology to a respiratory-chain NADH dehydrogenase subunit from about amino acid 243 to about amino acid 287. Clone DNA57711-1501 has been deposited with ATCC on Jul. 1, 1998 and is assigned ATCC deposit no. 203047.

An analysis of the Dayhoff database (version 35.45 SwissProt 35), using a WU-BLAST-2 sequence alignment analysis of the full-length sequence shown in FIG. 144 (SEQ ID NO:216), evidenced significant homology between the PRO1152 amino acid sequence and the following Dayhoff sequences: AF052239_1, SYNN9CGA_1, SFCYTB2_1, GEN12507, P_R11769, MTV025_109, C61168, S43171, P_P61689 and P_P61696.

Example 62

Isolation of cDNA Clones Encoding Human PRO1136

Use of the signal sequence algorithm described in Example 3 above allowed identification of an EST cluster sequence from the Incyte database, designated 109142. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56039.

In light of an observed sequence homology between the DNA56039 consensus sequence and an EST sequence encompassed within the Merck EST clone no. HSC1NF011, the Merck EST clone HSC1NF011 was purchased and the cDNA insert was obtained and sequenced. It was found that this insert encoded a full-length protein. The sequence of this cDNA insert is shown in FIG. 146 and is herein designated as DNA57827-1493.

Clone DNA57827-1493) contains a single open reading frame with an apparent translational initiation site at nucleotide positions 216–218 and ending at the stop codon at nucleotide positions 2112–2114 (FIG. 146). The predicted polypeptide precursor is 632 amino acids long (FIG. 147). The full-length PRO1136 protein shown in FIG. 147 has an estimated molecular weight of about 69,643 daltons and a pI of about 8.5. Analysis of the full-length PRO1136 sequence shown in FIG. 147 (SEQ ID NO:219) evidences the presence of the following: a signal peptide from about amino acid 1 to about amino acid 15 and potential N-glycosylation sites from about amino acid 108 to about amino acid 11, from about amino acid 157 to about amino acid 160, from about amino acid 289 to about amino acid 292 and from about amino acid 384 to about amino acid 387. Clone DNA57827-1493 has been deposited with ATCC on Jul. 1, 1998 and is assigned ATCC deposit no. 203045.

An analysis of the Dayhoff database (version 35.45 SwissProt 35), using a WU-BLAST2 sequence alignment analysis of the full-length sequence shown in FIG. 147 (SEQ ID NO:219), evidenced significant homology between the PRO1136 amino acid sequence and the following Dayhoff sequences: AF034746_1, AF034745_1, MMAF000168_19, HSMUPP1_1, AF060539_1, SP97_RAT, I38757, MMU93309_1, CEK01A6_4 and HSA224747_1.

Example 63

Isolation of cDNA Clones Encoding Human PRO813

Use of the signal sequence algorithm described in Example 3 above allowed identification of a single Incyte EST cluster sequence (Incyte EST cluster sequence no. 45501. The Incyte EST cluster sequence no. 45501 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56400.

In light of an observed sequence homology between the DNA56400 consensus sequence and an EST sequence encompassed within the Merck EST clone no. T90592, the Merck EST clone T90592 was purchased and the cDNA insert was obtained and sequenced. It was found that this insert encoded a full-length protein. The sequence of this cDNA insert is shown in FIG. 148 and is herein designated DNA57834-1339.

The full length clone shown in FIG. 148 contained a single open reading frame with an apparent translational initiation site at nucleotide positions 109–111 and ending at the stop codon found at nucleotide positions 637–639 (FIG. 149; SEQ ID NO:221). The predicted polypeptide precursor is 176 amino acids long, has a calculated molecular weight of approximately 19,616 daltons and an estimated pI of approximately 7.11. Analysis of the full-length PRO813 sequence shown in FIG. 149 (SEQ ID NO:221) evidences the presence of the following: a signal peptide from about amino acid 1 to about amino acid 26 and potential N-myristoylation sites from about amino acid 48 to about amino acid 53, from about amino acid 153 to about amino acid 158, from about amino acid 156 to about amino acid 161 and from about amino acid 167 to about amino acid 172. Clone DNA57834-1339 has been deposited with the ATCC on Jun. 9, 1998 and is assigned ATCC deposit no. 209954.

Analysis of the amino acid sequence of the full-length PRO813 polypeptide suggests that it possesses sequence similarity to the pulmonary surfactant-associated protein C. More specifically, an analysis of the Dayhoff database (version 35.45 SwissProt 35) evidenced some degree of homology between the PRO813 amino acid sequence and the following Dayhoff sequences, PSPC_MUSVI, P_P92071, G02964, P_R65489, P_P82977, P_R84555, S55542, MUSIGHAJ_1 and PH1158.

Example 64

Isolation of cDNA Clones Encoding Human PRO809

Use of the signal sequence algorithm described in Example 3 above allowed identification of a single Incyte EST cluster sequence. The Incyte EST cluster sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56418.

In light of an observed sequence homology between the DNA56418 consensus sequence and an EST sequence encompassed within the Merck EST clone no. H74302, the Merck EST clone H74302 was purchased and the cDNA insert was obtained and sequenced. It was found that this insert encoded a full-length protein. The sequence of this cDNA insert is shown in FIG. 150 and is herein designated DNA57836-1338.

The entire nucleotide sequence of DNA57836-1338 is shown in FIG. 150 (SEQ ID NO:222). Clone DNA57836-1338 contains a single open reading frame with an apparent translational initiation site at nucleotide positions 63–65 and ending at the stop codon at nucleotide positions 858–860 of SEQ ID NO:222 (FIG. 150). The predicted polypeptide precursor is 265 amino acids long (FIG. 151). The full-length PRO809 protein shown in FIG. 151 has an estimated molecular weight of about 29,061 daltons and a pi of about 9.18. FIG. 151 further shows the approximate positions of the signal peptide and N-glysosylation sites. The corresponding nucleotides can be determined by referencing FIG. 150. Clone DNA57836-1338 has been deposited with ATCC on Jun. 23, 1998. It is understood that the deposited clone has the actual nucleic acid sequence and that the sequences provided herein are based on known sequencing techniques.

Analysis of the amino acid sequence of the full-length PRO809 polypeptide suggests that it possesses some sequence similarity to the heparin sulfate proteoglycan and to endothelial cell adhesion molecule-1. More specifically, an analysis of the Dayhoff database (version 35.45 SwissProt 35) evidenced sequence identity between the PRO809 amino acid sequence and the following Dayhoff sequences, PGBM_MOUSE, D82082_1 and PW14158.

Example 65

Isolation of cDNA Clones Encoding Human PRO791

Use of the signal sequence algorithm described in Example 3 above allowed identification of a single Incyte EST cluster sequence. The Incyte EST cluster sequence was then compared to a variety of expressed sequence tag (EST)

databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56429.

In light of an observed sequence homology between the DNA56429 consensus sequence and an EST sequence encompassed within the Merck EST clone no. 36367, the Merck EST clone 36367 was purchased and the cDNA insert was obtained and sequenced. It was found that this insert encoded a full-length protein. The sequence of this cDNA insert is shown in FIG. 152 and is herein designated DNA57838-1337.

The entire nucleotide sequence of DNA57838-1337 is shown in FIG. 152 (SEQ ID NO:224). Clone DNA57838-1337 contains a single open reading frame with an apparent translational initiation site at nucleotide positions 9–11 and ending at the stop codon at nucleotide positions 747–749 of SEQ ID NO:224 (FIG. 152). The predicted polypeptide precursor is 246 amino acids long (FIG. 153). The full-length PRO791 protein shown in FIG. 153 has an estimated molecular weight of about 27,368 daltons and a pI of about 7.45. FIG. 153 also shows the approximate locations of the signal peptide, the transmembrane domain, N-glycosylation sites and a region conserved in extracellular proteins. The corresponding nucleotides of one embodiment provided herein can be identified by referencing FIG. 152. Clone DNA57838-1337 has been deposited with ATCC on Jun. 23, 1998. It is understood that the deposited clone has the actual nucleic acid sequence and that the sequences provided herein are based on known sequencing techniques.

Analysis of the amino acid sequence of the full-length PRO791 polypeptide suggests that it has sequence similarity with MHC-I antigens, thereby indicating that PRO791 may be related to MHC-I antigens. More specifically, an analysis of the Dayhoff database (version 35.45 SwissProt 35) evidenced some sequence identity between the PRO791 amino acid sequence and the following Dayhoff sequences, AF034346_1, MMQ1K5_1 and HFE_HUMAN.

Example 66

Isolation of cDNA Clones Encoding Human PRO1004

Use of the signal sequence algorithm described in Example 3 above allowed identification of a single Incyte EST cluster sequence, Incyte cluster sequence No. 73681. This EST cluster sequence was then compared to a variety of expressed sequence tag (EST) databases which included public EST databases (e.g., GenBank) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained therefrom is herein designated as DNA56516.

In light of an observed sequence homology between the DNA56516 consensus sequence and an EST sequence encompassed within the Merck EST clone no. H43837, the Merck EST clone H43837 was purchased and the cDNA insert was obtained and sequenced. It was found that this insert encoded a full-length protein. The sequence of this cDNA insert is shown in FIG. 154.

The full length clone shown in FIG. 154 contained a single open reading frame with an apparent translational initiation site at nucleotide positions 119–121 and ending at the stop codon at nucleotide positions 464466 (FIG. 154; SEQ ID NO:226). The predicted polypeptide precursor is 115 amino acids long (FIG. 155; SEQ ID NO:227). The full-length PRO1004 protein shown in FIG. 155 has an estimated molecular weight of about 13,649 daltons and a pI of about 9.58. Analysis of the full-length PRO1004 sequence shown in FIG. 155 (SEQ ID NO:227) evidences the presence of the following features: a signal peptide at about amino acids 1–24, a microbodies C-terminal targeting signal at about amino acids 113–115, a potential N-glycosylation site at about amino acids 71–74, and a domain having sequence identity with dihydrofolate reductase proteins at about amino acids 2248.

Analysis of the amino acid sequence of the full-length PRO1004 polypeptide using the Dayhoff database (version 35.45 SwissProt 35) evidenced homology between the PRO1004 amino acid sequence and the following Dayhoff sequences: CELR02D3_7, LECI_MOUSE, AF006691_3, SSZ97390_1, SSZ97395_1, and SSZ97400_1.

Clone DNA57844-1410 was deposited with the ATCC on Jun. 23, 1998, and is assigned ATCC deposit no. 203010.

Example 67

Isolation of cDNA Clones Encoding Human PRO1111

An expressed sequence tag (EST) DNA database (LIFESEQ®, Incyte Pharmaceuticals, Palo Alto, Calif.) was searched and an EST was identified which had homology to insulin-like growth factor binding protein.

RNA for construction of cDNA libraries was isolated from human fetal brain. The cDNA libraries used to isolate the cDNA clones encoding human PRO1111 were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., Science, 253:1278–1280 (1991)) in the unique XhoI and NotI.

The human fetal brain cDNA libraries (prepared as described above), were screened by hybridization with a synthetic oligonucleotide probe based upon the Incyte EST sequence described above:
5'-CCACCACCTGGAGGTCCTGCAGTTGGGCAGGA
ACTCCATCCGGCAGATTG-3' (SEQ ID NO:251).

An identified cDNA clone was sequenced in entirety. The entire nucleotide sequence of PRO1111 is shown in FIG. 156 (SEQ ID NO:228). Clone DNA58721-1475 contains a single open reading frame with an apparent translational initiation site at nucleotide positions 57–59 and a stop codon at nucleotide positions 2016–2018 (FIG. 156; SEQ ID NO:228). The predicted polypeptide precursor is 653 amino acids long (FIG. 157). The transmembrane domains are at positions 2140 (type II) and 528–548. Clone DNA58721-1475 has been deposited with ATCC and is assigned ATCC deposit no. 203110. The full-length PRO1111 protein shown in FIG. 157 has an estimated molecular weight of about 72,717 daltons and a pI of about 6.99.

An analysis of the Dayhoff database (version 35.45 SwissProt 35), using a WU-BLAST2 sequence alignment analysis of the full-length sequence shown in FIG. 157 (SEQ ID NO:229), revealed some sequence identity between the PRO1111 amino acid sequence and the following Dayhoff sequences: A58532, D86983_1, RNPLGPV_1, PGS2_HUMAN, AF038127_1, ALS_MOUSE, GPV_HUMAN, PGS2_BOVIN, ALS_PAPPA and I47020.

Example 68

Isolation of cDNA Clones Encoding Human PRO1344

A consensus DNA sequence was assembled relative to other EST sequences using phrap as described in Example 1 above. This consensus sequence is herein designated DNA33790. Based on the DNA33790 consensus sequence, oligonucleotides were synthesized: 1) to identify by PCR a cDNA library that contained the sequence of interest, and 2) for use as probes to isolate a clone of the full-length coding sequence for PRO1344.

PCR primers (forward and reverse) were synthesized:

```
forward PCR primer  5'-AGGTTCGTGATGGGAGACAACCGCG-3' (SEQ ID NO:232)
reverse PCR primer  5'-TGTCAAGGACGCACTGCCGTCATG-3' (SEQ ID NO:233)
```

Additionally, a synthetic oligonucleotide hybridization probe was constructed from the consensus DNA33790 sequence which had the following nucleotide sequence
Hybridization Probe
5'-TGGCCAGATCATCAAGCGTGTCTGTGGCAACG AGCGGCCAGCTCCTATCC-3' (SEQ ID NO:234)

In order to screen several libraries for a source of a full-length clone, DNA from the libraries was screened by PCR amplification with the PCR primer pair identified above. A positive library was then used to isolate clones encoding the PRO1344 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1344 (designated herein as DNA58723-1588 [FIG. 158, SEQ ID NO:230]); and the derived protein sequence for PRO1344.

The entire nucleotide sequence of DNA58723-1588 is shown in FIG. 158 (SEQ ID NO:230). Clone DNA58723-1588 contains a single open reading frame with an apparent translational initiation site at nucleotide positions 26–28 and ending at the stop codon at nucleotide positions 2186–2188 (FIG. 158). The predicted polypeptide precursor is 720 amino acids long (FIG. 159). The full-length PRO1344 protein shown in FIG. 159 has an estimated molecular weight of about 80,199 daltons and a pI of about 7.77. Analysis of the full-length PRO1344 sequence shown in FIG. 159 (SEQ ID NO:231) evidences the presence of the following: a signal peptide from about amino acid 1 to about amino acid 23, an EGF-like domain cysteine protein signature sequence from about amino acid 260 to about amino acid 271, potential N-glycosylation sites from about amino acid 96 to about amino acid 99, from about amino acid 279 to about amino acid 282, from about amino acid 316 to about amino acid 319, from about amino acid 451 to about amino acid 454 and from about amino acid 614 to about amino acid 617, an amino acid sequence block having homology to serine proteases, trypsin family from about amino acid 489 to about amino acid 505 and a CUB domain protein profile sequence from about amino acid 150 to about amino acid 166. Clone DNA58723-1588 has been deposited with ATCC on Aug. 18, 1998 and is assigned ATCC deposit no. 203133.

An analysis of the Dayhoff database (version 35.45 SwissProt 35), using a WU-BLAST2 sequence alignment analysis of the full-length sequence shown in FIG. 159 (SEQ ID NO:231), evidenced significant homology between the PRO1344 amino acid sequence and the following Dayhoff sequences: S77063_1, CRAR_MOUSE, P_R74775, P_P90070, P_R09217, P_P70475, HSBMP16_1 and U50330_1.

Example 69

Isolation of cDNA Clones Encoding Human PRO1109

A consensus DNA sequence was assembled relative to other EST sequences using phrap as described in Example 1 above. This consensus sequence is herein designated DNA52642. The consensus DNA sequence was obtained by extending using repeated cycles of BLAST and phrap a previously obtained consensus sequence as far as possible using the sources of EST sequences discussed above. Based on the DNA52642 consensus sequence, oligonucleotides were synthesized: 1) to identify by PCR a cDNA library that contained the sequence of interest, and 2) for use as probes to isolate a clone of the full-length coding sequence for PRO1109.

PCR primers (forward and reverse) were synthesized:

```
forward PCR primer  5'-CCTTACCTCAGAGGCCAGAGCAAGC-3' (SEQ ID NO:237)
reverse PCR primer  5'-GAGCTTCATCCGTTCTGCGTTCACC-3' (SEQ ID NO:238)
```

Additionally, a synthetic oligonucleotide hybridization probe was constructed from the consensus DNA52642 sequence which had the following nucleotide sequence
Hybridization Probe
5'-CAGGAATGTAAAGCTTTACAGAGGGTCGCCAT CCTCGTTCCCCACC-3' (SEQ ID NO:239)

In order to screen several libraries for a source of a full-length clone, DNA from the libraries was screened by PCR amplification with the PCR primer pair identified above. A positive library was then used to isolate clones encoding the PRO1109 gene using the probe oligonucleotide and one of the PCR primers. RNA for construction of the cDNA libraries was isolated from human SK-Lu-1 adenocarcinoma cell tissue (LIB247).

DNA sequencing of the clones isolated as described above gave the full-length DNA sequence for PRO1109 (designated herein as DNA58737-1473 [FIG. 160, SEQ ID NO:235]) and the derived protein sequence for PRO1109.

The entire nucleotide sequence of DNA58737-1473 is shown in FIG. 160 (SEQ ID NO:235). Clone DNA58737-1473 contains a single open reading frame with an apparent translational initiation site at nucleotide positions 119–120 and ending at the stop codon at nucleotide positions 1151–1153 (FIG. 160). The predicted polypeptide precursor is 344 amino acids long (FIG. 161). The full-length PRO1109 protein shown in FIG. 161 has an estimated molecular weight of about 40,041 daltons and a pI of about 9.34. Analysis of the full-length PRO1109 sequence shown in FIG. 161 (SEQ ID NO:236) evidences the presence of the following: a signal peptide from about amino acid 1 to about amino acid 27, potential N-glycosylation sites from about amino acid 4 to about amino acid 7, from about amino acid 220 to about amino acid 223 and from about amino acid 335 to about amino acid 338 and an amino acid sequence block having homology to xylose isomerase proteins from about amino acid 191 to about amino acid 201. Clone DNA58737-1473 has been deposited with ATCC on Aug. 18, 1998 and is assigned ATCC deposit no. 203136.

An analysis of the Dayhoff database (version 35.45 SwissProt 35), using a WU-BLAST2 sequence alignment analysis of the full-length sequence shown in FIG. 161 (SEQ ID NO:236), evidenced significant homology between the PRO1109 amino acid sequence and the following Dayhoff sequences: HSUDPGAL_1, IISUDPB14_1, NALS_BOVIN, HSU10473_1, CEW02B12_11, YNJ4_CAEEL, AE000738_11, CET24D1_1, S48121 and CEGLY9_1.

Example 70

Isolation of cDNA Clones Encoding Human PRO1383

A consensus DNA sequence was assembled relative to other EST sequences using phrap as described in Example 1 above. This consensus sequence is herein designated DNA53961. Based on the DNA53961 consensus sequence, oligonucleotides were synthesized: 1) to identify by PCR a cDNA library that contained the sequence of interest, and 2) for use as probes to isolate a clone of the full-length coding sequence for PRO1383.

PCR primers (forward and reverse) were synthesized:

otide and one of the PCR primers. RNA for construction of the cDNA libraries was isolated from human fetal brain tissue.

DNA sequencing of the clones isolated as described above gave the full-length DNA sequence for PRO1383 (designated herein as DNA58743-1609 [FIG. 162, SEQ ID NO:240]) and the derived protein sequence for PRO1383.

The entire nucleotide sequence of DNA58743-1609 is shown in FIG. 162 (SEQ ID NO:240). Clone DNA58743-1609 contains a single open reading frame with an apparent translational initiation site at nucleotide positions 122–124 and ending at the stop codon at nucleotide positions 1391–1393 (FIG. 162). The predicted polypeptide precursor is 423 amino acids long (FIG. 163). The full-length PRO1383 protein shown in FIG. 163 has an estimated molecular weight of about 46,989 daltons and a pI of about 6.77. Analysis of the full-length PRO1383 sequence shown in FIG. 163 (SEQ ID NO:241) evidences the presence of the following: a signal peptide from about amino acid 1 to about amino acid 24, a transmembrane domain from about amino acid 339 to about amino acid 362, and potential N-glycosylation sites from about amino acid 34 to about amino acid 37, from about amino acid 58 to about amino acid 61, from about amino acid 142 to about amino acid 145, from about amino acid 197 to about amino acid 200, from about amino acid 300 to about amino acid 303 and from about amino acid 364 to about amino acid 367. Clone DNA58743-1609 has been deposited with ATCC on Aug. 25, 1998 and is assigned ATCC deposit no. 203154.

An analysis of the Dayhoff database (version 35.45 SwissProt 35), using a WU-BLAST2 sequence alignment analysis of the full-length sequence shown in FIG. 163 (SEQ ID NO:241), evidenced significant homology between the PRO1383 amino acid sequence and the following Dayhoff sequences: NMB_HUMAN, QNR_COTJA, P_W38335, P115_CHICK, P_W38164, A45993_1, MMU70209_1, D83704_1 and P_W39176.

Example 71

Isolation of cDNA Clones Encoding Human PRO1003

Use of the signal sequence algorithm described in Example 3 above allowed identification of a single Incyte EST cluster sequence designated herein as 43055. This sequence was then compared to a variety of EST databases which included public EST databases (e.g., GenBank) and a proprietary EST DNA database (LIFESEQ™, Incyte Pharmaceuticals, Palo Alto, Calif.) to identify existing

```
forward PCR primer   5'-CATTTCCTTACCCTGGACCCAGCTCC-3'  (SEQ ID NO:242)

reverse PCR primer   5'-GAAAGGCCCACAGCACATCTGGCAG-3'  (SEQ ID NO:243)
```

Additionally, a synthetic oligonucleotide hybridization probe was constructed from the consensus DNA53961 sequence which had the following nucleotide sequence Hybridization Probe

5'-CCACGACCCGAGCAACTTCCTCAAGACCGACT TGTTTCTCTACAGC-3' (SEQ ID NO:244)

In order to screen several libraries for a source of a full-length clone, DNA from the libraries was screened by PCR amplification with the PCR primer pair identified above. A positive library was then used to isolate clones encoding the PRO1383 gene using the probe oligonuclehomologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated consen01.

In light of an observed sequence homology between the consensus sequence and an EST sequence encompassed within the Incyte EST clone no. 2849382, the Incyte EST clone 2849382 was purchased and the cDNA insert was obtained and sequenced. It was found that this insert encoded a full-length protein. The sequence of this cDNA insert is shown in FIG. 164.

The entire nucleotide sequence of DNA58846-1409 is shown in FIG. 164 (SEQ ID NO:245). Clone DNA58846-1409 contains a single open reading frame with an apparent translational initiation site at nucleotide positions 41–43 and ending at the stop codon at nucleotide positions 293–295 (FIG. 164). The predicted polypeptide precursor is 84 amino acids long (FIG. 165). The full-length PRO1003 protein shown in FIG. 165 has an estimated molecular weight of about 9,408 daltons and a pI of about 9.28. Analysis of the full-length PRO1003 sequence shown in FIG. 165 (SEQ ID NO:246) evidences the presence of a signal peptide at amino acids 1 to about 24, and a cAMP- and cGMP-dependent protein kinase phosphorylation site at about amino acids 58 to about 61. Analysis of the amino acid sequence of the full-length PRO1003 polypeptide using the Dayhoff database (version 35.45 SwissProt 35) evidenced homology between the PRO1003 amino acid sequence and the following Dayhoff sequences: AOPCZA363_3, SRTX_ATREN, A48298, MHVJHMS_1, VGL2_CVMJH, DHDHTC2_2, CORT_RAT, TAL6_HUMAN, P_W14123, and DVUFI_2.

Example 72

Isolation of cDNA Clones Encoding Human PRO1108

A consensus DNA sequence was assembled relative to other EST sequences using phrap as described in Example 1 above. This consensus sequence is herein designated DNA53237.

In light of an observed sequence homology between the DNA53237 consensus sequence and an EST sequence encompassed within the Incyte EST clone no. 2379881, the Incyte EST clone 2379881 was purchased and the cDNA insert was obtained and sequenced. It was found that this insert encoded a full-length protein. The sequence of this cDNA insert is shown in FIG. 166 and is herein designated DNA58848-1472.

The entire nucleotide sequence of DNA58848-1472 is shown in FIG. 166 (SEQ ID NO:247). Clone DNA58848-1472 contains a single open reading frame with an apparent translational initiation site at nucleotide positions 77–79 and ending at the stop codon at nucleotide positions 1445–1447 (FIG. 166). The predicted polypeptide precursor is 456 amino acids long (FIG. 167). The full-length PRO1108 protein shown in FIG. 167 has an estimated molecular weight of about 52,071 daltons and a pI of about 9.46. Analysis of the full-length PRO1108 sequence shown in FIG. 167 (SEQ ID NO:248) evidences the presence of the following: type II transmembrane domains from about amino acid 22 to about amino acid 42, from about amino acid 156 to about amino acid 176, from about amino acid 180 to about amino acid 199 and from about amino acid 369 to about amino acid 388, potential N-glycosylaion sites from about amino acid 247 to about amino acid 250, from about amino acid 327 to about amino acid 330, from about amino acid 328 to about amino acid 331 and from about amino acid 362 to about amino acid 365 and an amino acid block having homology to ER lumen protein retaining receptor protein from about amino acid 153 to about amino acid 190. Clone DNA58848-1472 has been deposited with ATCC on Jun. 9, 1998 and is assigned ATCC deposit no. 209955.

Analysis of the amino acid sequence of the full-length PRO1108 polypeptide suggests that it possesses significant sequence similarity to the LPAAT protein, thereby indicating that PRO1108 maybe a novel LPAAT homolog. More specifically, an analysis of the Dayhoff database (version 35.45 SwissProt 35) evidenced significant homology between the PRO1108 amino acid sequence and the following Dayhoff sequences, AF015811_1, CER07E3_2, YL35_CAEEL, S73863, CEF59F4_4, P_W06422, MMU41736_1, MTV008_39, P_R99248 and Y67_BPT7.

Example 73

Isolation of cDNA Clones Encoding Human PRO1137

The extracellular domain (ECD) sequences (including the secretion signal, if any) of from about 950 known secreted proteins from the Swiss-Prot public protein database were used to search expressed sequence tag (EST) databases. The EST databases included public EST databases (e.g., GenBank) and a proprietary EST DNA database (LIFESEQ™, Incyte Pharmaceuticals, Palo Alto, Calif.). The search was performed using the computer program BLAST or BLAST2 (Altshul et al., Methods in Enzymology 266:460–480 (1996)) as a comparison of the ECD protein sequences to a 6 frame translation of the EST sequence. Using this procedure, Incyte EST No. 3459449, also referred to herein as "DNA7108", was identified as an EST having a BLAST score of 70 or greater that did not encode a known protein.

A consensus DNA sequence was assembled relative to the DNA7108 sequence and other ESTs using repeated cycles of BLAST and the program "phrap" (Phil Green, Univ. of Washington, Seattle, Wash.). The consensus sequence obtained therefrom is referred to herein as DNA53952.

In light of an observed sequence homology between the DNA53952 consensus sequence and an EST sequence encompassed within the Incyte EST clone no. 3663102, the Incyte EST clone 3663102 was purchased and the cDNA insert was obtained and sequenced. It was found that this insert encoded a full-length protein. The sequence of this cDNA insert is shown in FIG. 168.

The entire nucleotide sequence of DNA58849-1494 is shown in FIG. 168 (SEQ ID NO:249). Clone DNA58849-1494 contains a single open reading frame with an apparent translational initiation site at nucleotide positions 77–79 and ending at the stop codon at nucleotide positions 797–799 (FIG. 168). The predicted polypeptide precursor is 240 amino acids long (FIG. 169). The full-length PRO1137 protein shown in FIG. 169 has an estimated molecular weight of about 26,064 daltons and a pI of about 8.65. Analysis of the full-length PRO1137 sequence shown in FIG. 169 (SEQ ID NO:250) evidences the presence of a signal peptide at about amino acids 1 to 14 and a potential N-glycosylation site at about amino acids 101–105.

Analysis of the amino acid sequence of the full-length PRO1137 polypeptide suggests that it possesses significant sequence similarity to ribosyltransferase thereby indicating that PRO1137 may be a novel member of the ribosyltransferase family of proteins. Analysis of the amino acid sequence of the full-length PRO1137 polypeptide using the Dayhoff database (version 35.45 SwissProt 35) evidenced homology between the PRO1137 amino acid sequence and the following Dayhoff sequences: MMART5_1, NARG_MOUSE, GEN11909, GEN13794, GEN14406, MmRNART62_1, and P_R41876.

Example 74

Isolation of cDNA Clones Encoding Human PRO1138

Use of the signal sequence algorithm described in Example 3 above allowed identification of a single Incyte EST sequence, Incyte cluster sequence no. 165212. This cluster sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated as DNA54224. The assembly included a proprietary Genentech EST designated herein as DNA49140 (FIG. 172; SEQ ID NO:254).

In light of an observed sequence homology between the DNA54224 consensus sequence and an EST sequence encompassed within the Incyte EST clone no. 3836613, the Incyte EST clone 3836613 was purchased and the cDNA insert was obtained and sequenced. It was found that this insert encoded a full-length protein. The sequence of this cDNA insert is shown in FIG. 170 and is the full-length DNA sequence for PRO1138. Clone DNA58850-1495 was deposited with the ATCC on Jun. 9, 1998, and is assigned ATCC deposit no. 209956.

The entire nucleotide sequence of DNA58850-1495 is shown in FIG. 170 (SEQ ID NO:252). Clone DNA58850-1495 contains a single open reading frame with an apparent translational initiation site at nucleotide positions 38–40 and ending at the stop codon at nucleotide positions 1043–1045 (FIG. 170). The predicted polypeptide precursor is 335 amino acids long (FIG. 171). The full-length PRO1138 protein shown in FIG. 171 has an estimated molecular weight of about 37,421 Daltons and a pI of about 6.36. Analysis of the full-length PRO1138 sequence shown in FIG. 171 (SEQ ID NO:253) evidences the presence of the following features: a signal peptide at about amino acid 1 to about amino acid 22; a transmembrane domain at about amino acids 224 to about 250; a leucine zipper pattern at about amino acids 229 to about 250; and potential N-glycosylation sites at about amino acids 98–101, 142–145, 148–151, 172–175, 176–179, 204–207, and 291–295.

Analysis of the amino acid sequence of the full-length PRO1138 polypeptide suggests that it possesses significant sequence similarity to the CD84, thereby indicating that PRO1138 may be a novel member of the Ig superfamily of polypeptides. More particularly, analysis of the amino acid sequence of the full-length PRO1138 polypeptide using the Dayhoff database (version 35.45 SwissProt 35) evidenced homology between the PRO1138 amino acid sequence and the following Dayhoff sequences: HSU82988_1, HUMLY9_1, P_R97631, P_R97628, P_R97629, P_R97630, CD48_RAT, CD2_HUMAN, P_P93996, and HUMBGP_1.

Clone DNA58850-1495 was deposited with ATCC on Jun. 9, 1998, and is assigned ATCC deposit no. 209956.

Example 75

Isolation of cDNA Clones Encoding Human PRO1054

Use of the signal sequence algorithm described in Example 3 above allowed identification of an EST cluster sequence from the Incyte database, designated 66212. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55722.

In light of an observed sequence homology between the DNA55722 consensus sequence and an EST sequence encompassed within the Incyte EST clone no. 319751, the Incyte EST clone 319751 was purchased and the cDNA insert was obtained and sequenced. It was found that this insert encoded a full-length protein. The sequence of this cDNA insert is shown in FIG. 173 and is herein designated as DNA58853-1423.

Clone DNA58853-1423 contains a single open reading frame with an apparent translational initiation site at nucleotide positions 46–48 and ending at the stop codon at nucleotide positions 586–588 (FIG. 173). The predicted polypeptide precursor is 180 amino acids long (FIG. 174). The full-length PRO1054 protein shown in FIG. 174 has an estimated molecular weight of about 20,638 daltons and a pI of about 5.0. Analysis of the full-length PRO1054 sequence shown in FIG. 174 (SEQ ID NO:256) evidences the presence of the following: a signal peptide from about amino acid 1 to about amino acid 18, a leucine zipper pattern from about amino acid 155 to about amino acid 176 and amino acid sequence blocks having homology to lipocalin proteins from about amino acid 27 to about amino acid 38 and from about amino acid 110 to about amino acid 120. Clone DNA58853-1423 has been deposited with ATCC on Jun. 23, 1998 and is assigned ATCC deposit no. 203016.

An analysis of the Dayhoff database (version 35.45 SwissProt 35), using a WU-BLAST2 sequence alignment analysis of the full-length sequence shown in FIG. 174 (SEQ ID NO:256), evidenced significant homology between the PRO1054 amino acid sequence and the following Dayhoff sequences: MUP1_MOUSE, MUP6_MOUSE, MUP2_MOUSE, MUP8_MOUSE, MUP5_MOUSE, MUP4_MOUSE, S10124, MUPM_MOUSE, MUP_RAT and ECU70823_1.

Example 76

Isolation of cDNA Clones Encoding Human PRO994

Use of the signal sequence algorithm described in Example 3 above allowed identification of an EST cluster sequence from the Incyte database, designated 157555. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55728.

In light of an observed sequence homology between the DNA55728 consensus sequence and an EST sequence encompassed within the Incyte EST clone no. 2860366, the Incyte EST clone 2860366 was purchased and the cDNA insert was obtained and sequenced. It was found that this insert encoded a full-length protein. The sequence of this cDNA insert is shown in FIG. 175 and is herein designated as DNA58855-1422.

Clone DNA58855-1422 contains a single open reading frame with an apparent translational initiation site at nucleotide positions 31–33 and ending at the stop codon at nucleotide positions 718–720 (FIG. 175). The predicted polypeptide precursor is 229 amino acids long (FIG. 176). The full-length PRO994 protein shown in FIG. 176 has an estimated molecular weight of about 25,109 daltons and a pI of about 6.83. Analysis of the full-length PRO994 sequence shown in FIG. 176 (SEQ ID NO:258) evidences the presence of the following: transmembrane domains from about amino acid 10 to about amino acid 31, from about amino acid 50 to about amino acid 72, from about amino acid 87 to about amino acid 110 and from about amino acid 191 to about amino acid 213, potential N-glycosylation sites from about amino acid 80 to about amino acid 83, from about amino acid 132 to about amino acid 135, from about amino acid 148 to about amino acid 151 and from about amino acid 163 to about amino acid 166 and an amino acid block having homology to TNFR/NGFR cysteine-rich region proteins from about amino acid 4 to about amino acid 11. Clone DNA58855-1422 has been deposited with ATCC on Jun. 23, 1998 and is assigned ATCC deposit no. 203018.

An analysis of the Dayhoff database (version 35.45 SwissProt 35), using a WU-BLAST2 sequence alignment analysis of the full-length sequence shown in FIG. 176 (SEQ ID NO:258), evidenced significant homology between the PRO994 amino acid sequence and the following Dayhoff sequences: AF027204_1, TAL6_HUMAN, ILT4_HUMAN, JC6205, MMU57570_1, S40363, ETU56093_1, S42858, P_R66849 and P_R74751.

Example 77

Isolation of cDNA Clones Encoding Human PRO812

Use of the signal sequence algorithm described in Example 3 above allowed identification of an EST cluster sequence from the Incyte database, designated 170079. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated as DNA55721.

In light of an observed sequence homology between the DNA55721 consensus sequence and an EST sequence encompassed within the Incyte EST clone no. 388964, the Incyte EST clone 388964 was purchased and the cDNA insert was obtained and sequenced. It was found that this insert encoded a full-length protein. The sequence of this cDNA insert is shown in FIG. 177 and is herein designated as DNA59205-1421.

Clone DNA59205-1421 contains a single open reading frame with an apparent translational initiation site at nucleotide positions 55–57 and ending at the stop codon at nucleotide positions 304–306 (FIG. 177). The predicted polypeptide precursor is 83 amino acids long (FIG. 178). The full-length PRO812 protein shown in FIG. 178 has an estimated molecular weight of about 9,201 daltons and a pI of about 9.3. Analysis of the full-length PRO812 sequence shown in FIG. 178 (SEQ ID NO:260) evidences the presence of the following: a signal peptide from about amino acid 1 to about amino acid 15, a cAMP- and cGMP-dependent protein kinase phosphorylation site from about amino acid 73 to about amino acid 76 and protein kinase C phosphorylation sites from about amino acid 70 to about amino acid 72 and from about amino acid 76 to about amino acid 78. Clone DNA59205-1421 has been deposited with ATCC on Jun. 23, 1998 and is assigned ATCC deposit no. 203009.

An analysis of the Dayhoff database (version 35.45 SwissProt 35), using a WU-BLAST2 sequence alignment analysis of the full-length sequence shown in FIG. 178 (SEQ ID NO:260), evidenced significant homology between the PRO812 amino acid sequence and the following Dayhoff sequences: P_W35802, P_W35803, PSC1_RAT, S68231, GEN13917, PSC2_RAT, CC10_HUMAN, UTER_RABIT, AF008595_1 and A56413.

Example 78

Isolation of cDNA Clones Encoding Human PRO1069

Use of the signal sequence algorithm described in Example 3 above allowed identification of a single Incyte EST sequence designated herein as 100727. This sequence was then compared to a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained therefrom is herein designated DNA56001.

In light of an observed sequence homology between the DNA56001 consensus sequence and an EST sequence encompassed within the Incyte EST clone no. 3533881, the Incyte EST clone 3533881 was purchased and the cDNA insert was obtained and sequenced. It was found that this insert encoded a full-length protein. The sequence of this cDNA insert is shown in FIG. 179 and is the full-length DNA sequence for PRO1069. Clone DNA59211-1450 was deposited with the ATCC on Jun. 9, 1998, and is assigned ATCC deposit no. 209960.

The entire nucleotide sequence of DNA59211-1450 is shown in FIG. 179 (SEQ ID NO:261). Clone DNA59211-1450 contains a single open reading frame with an apparent translational initiation site at nucleotide positions 197–199 and ending at the stop codon at nucleotide positions 464–466. The predicted polypeptide precursor is 89 amino acids long (FIG. 180). The full-length PRO1069 protein shown in FIG. 180 has an estimated molecular weight of about 9,433 daltons and a pI of about 8.21. Analysis of the full-length PRO1069 sequence shown in FIG. 180 (SEQ ID NO:262) evidences the presence of the following features: a signal peptide sequence at amino acid 1 to about 16; a transmembrane domain at about amino acids 36 to about 59; potential N-myristoylation sites at about amino acids 41–46, 45–50, and 84–89; and homology with extracellular proteins SCP/Tpx-1/Ag5/PR-1/Sc7 at about amino acids 54 to about 66.

Analysis of the amino acid sequence of the full-length PRO1069 polypeptide suggests that it possesses significant sequence similarity to CHIF, thereby indicating that PRO1069 maybe a member of the CHIF family of polypeptides. More particularly, analysis of the amino acid sequence of the full-length PRO1069 polypeptide using the Dayhoff database (version 35.45 SwissProt 35) evidenced homology between the PRO1069 amino acid sequence and the following Dayhoff sequences: CHIF_RAT, A55571, PLM_HUMAN, A40533, ATNG_BOVIN, RIC_MOUSE, PETD_SYNY3, VTB1_XENLA, A05009, and S75086.

Clone DNA59211-1450 was deposited with the ATCC on Jun. 9, 1998, and is assigned ATCC deposit no. 209960.

Example 79

Isolation of cDNA Clones Encoding Human PRO1129

Use of the signal sequence algorithm described in Example 3 above allowed identification of a single Incyte EST cluster sequence designated herein as 98833. The Incyte EST cluster sequence no. 98833 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56038.

In light of an observed sequence homology between the DNA56038 consensus sequence and an EST sequence encompassed within the Incyte EST clone no. 1335241, the Incyte EST clone 1335241 was purchased and the cDNA insert was obtained and sequenced. It was found that this insert encoded a full-length protein. The sequence of this cDNA insert is shown in FIG. 181 and is herein designated DNA59213-1487.

The full length clone shown in FIG. 181 contained a single open reading frame with an apparent translational initiation site at nucleotide positions 4244 and ending at the stop codon found at nucleotide positions 1614–1616 (FIG. 181; SEQ ID NO:263). The predicted polypeptide precursor is 524 amino acids long, has a calculated molecular weight of approximately 60,310 daltons and an estimated pI of approximately 7.46. Analysis of the full-length PRO1129 sequence shown in FIG. 182 (SEQ ID NO:264) evidences the presence of the following: type II transmembrane domains from about amino acid 13 to about amino acid 32 and from about amino acid 77 to about amino acid 102, a cytochrome P-450 cysteine heme-iron ligand signature sequence from about amino acid 461 to about amino acid 470 and potential N-glycosylation sites from about amino acid 112 to about amino acid 115 and from about amino acid 168 to about amino acid 171. Clone DNA59213-1487 has been deposited with the ATCC on Jun. 9, 1998 and is assigned ATCC deposit no. 209959.

Analysis of the amino acid sequence of the full-length PRO1129 polypeptide suggests that it possesses sequence similarity to the cytochrome P-450 family of proteins. More specifically, an analysis of the Dayhoff database (version 35.45 SwissProt 35) evidenced some degree of homology between the PRO1129 amino acid sequence and the following Dayhoff sequences, AC004523_1, S45702, AF054821_1 and I53015.

Example 80

Isolation of cDNA Clones Encoding Human PRO1068

Use of the signal sequence algorithm described in Example 3 above allowed identification of an EST cluster sequence from the LIFESEQ® database, designated Incyte cluster no. 141736. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a human mast cell line from a patient with mast cell leukemia. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56094.

In light of an observed sequence homology between the DNA56094 consensus sequence and an EST sequence encompassed within the Incyte EST clone no. 004974, the Incyte EST clone 004974 was purchased and the cDNA insert was obtained and sequenced. It was found that this insert encoded a full-length protein. The sequence of this cDNA insert is shown in FIG. 183 and is herein designated as DNA59214-1449 (SEQ ID NO:265).

The full length clone shown in FIG. 183 contained a single open reading frame with an apparent translational initiation site at nucleotide positions 42–44 and ending at the stop codon found at nucleotide positions 414–416 (FIG. 183; SEQ ID NO:265). The predicted polypeptide precursor (FIG. 184, SEQ ID NO:266) is 124 amino acids long. PRO1068 has a calculated molecular weight of approximately 14,284 daltons and an estimated pI of approximately 8.14. The PRO1068 polypeptide has the following additional features: a signal peptide sequence at about amino acids 1–20, a urotensin II signature sequence at about amino acids 118–123, a cell attachment sequence at about amino acids 64–66, and a potential cAMP- and cGMP-dependent protein kinase phosphorylation site at about amino acids 112–115.

An analysis of the Dayhoff database (version 35.45 SwissProt 35), using a WU-BLAST2 sequence alignment analysis of the full-length sequence shown in FIG. 184 (SEQ ID NO:266), revealed homology between the PRO1068 amino acid sequence and the following Dayhoff sequences: HALBOP_1, MTV043_36, I50498, and P_R78445.

Clone DNA59214-1449 was deposited with the ATCC on Jul. 1, 1998 and is assigned ATCC deposit no.203046.

Example 81

Isolation of cDNA Clones Encoding Human PRO1066

Use of the signal sequence algorithm described in Example 3 above allowed identification of a single Incyte EST cluster sequence designated herein as 79066. The Incyte EST cluster sequence no. 79066 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56121.

In light of an observed sequence homology between the DNA56121 consensus sequence and an EST sequence encompassed within the Incyte EST clone no. 1515315, the Incyte EST clone 1515315 was purchased and the cDNA insert was obtained and sequenced. It was found that this insert encoded a full-length protein. The sequence of this cDNA insert is shown in FIG. 185 and is herein designated DNA59215-1425.

The full length clone shown in FIG. 185 contained a single open reading frame with an apparent translational initiation site at nucleotide positions 176–178 and ending at the stop codon found at nucleotide positions 527–529 (FIG. 185; SEQ ID NO:267). The predicted polypeptide precursor is 117 amino acids long, has a calculated molecular weight of approximately 12,911 daltons and an estimated pI of approximately 5.46. Analysis of the full-length PRO1066 sequence shown in FIG. 186 (SEQ ID NO:268) evidences the presence of the following: a signal peptide from about amino acid 1 to about amino acid 23, a cAMP- and cGMP-dependent protein kinase phosphorylation site from about amino acid 38 to about amino acid 41 and potential N-myristoylation sites from about amino acid 5 to about amino acid 10, from about amino acid 63 to about amino acid 68 and from about amino acid 83 to about amino acid 88. Clone UNQ524 (DNA59215-1425) has been deposited with the ATCC on Jun. 9, 1998 and is assigned ATCC deposit no. 209961.

Analysis of the amino acid sequence of the full-length PRO1066 polypeptide suggests that it does not possess significant sequence similarity to any known human protein. However, an analysis of the Dayhoff database (version 35.45 SwissProt 35) evidenced some degree of homology between the PRO1066 amino acid sequence and the following Dayhoff sequences, MOTI_HUMAN, AF025667_1, MTCY19H9_8 and RABIGKCH_1.

Example 82

Isolation of cDNA Clones Encoding Human PRO1184

Use of the signal sequence algorithm described in Example 3 on ESTs from an Incyte database allowed iden-tification a candidate sequence designated herein as DNA56375. This sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56375.

In light of an observed sequence homology between the DNA56375 consensus sequence and an EST sequence encompassed within the Incyte EST clone no. 1428374, the Incyte EST clone 1428374 was purchased and the cDNA insert was obtained and sequenced. It was found that this insert encoded a full-length protein. The sequence of this cDNA insert is shown in FIG. 187.

The full length clone shown in FIG. 187 contained a single open reading frame with an apparent translational initiation site at nucleotide positions 106–108 and ending at the stop codon found at nucleotide positions 532–534 (FIG. 187; SEQ ID NO:269). The predicted polypeptide precursor is 142 amino acids long, has a calculated molecular weight of approximately 15,690 daltons and an estimated pI of approximately 9.64. Analysis of the full-length PRO1184 sequence shown in FIG. 188 (SEQ ID NO:270) evidences the presence of a signal peptide at about amino acids 1–38. Clone DNA59220-1514 has been deposited with the ATCC on Jun. 9, 1998. It is understood that the deposited clone has the actual sequences and that representations are presented herein.

Analysis of the amino acid sequence of the full-length PRO1184 polypeptide suggests that it possesses some sequence identity with a protein called TIM from *Drosophila virilis*, designated "DVTIMSO$_2$_1" in the Dayhoff data base, (version 35.45 SwissProt 35). Other Dayhoff database (version 35.45 SwissProt 35) sequences having some degree of sequence identity with PRO1184 include: WIS1_SCHPO, F002186_1, ATAC00239124 and MSAIPRP_1.

Example 83

Isolation of cDNA Clones Encoding Human PRO1360

Use of the signal sequence algorithm described in Example 3 above allowed identification of an EST sequence from an Incyte database, designated DNA10572. This EST sequence was then compared to a variety of expressed sequence tag (EST) databases which included public EST databases (e.g., GenBank, Merck/Wash. U.) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57314.

In light of an observed sequence homology between the DNA57314 consensus sequence and an EST sequence encompassed within the Merck EST clone no. AA406443, the Merck EST clone AA406443 was purchased and the cDNA insert was obtained and sequenced. It was found that this insert encoded a full-length protein. The sequence of this cDNA insert is shown in FIG. 189 and is herein designated as DNA59488-1603.

The full length clone shown in FIG. 189 contained a single open reading frame with an apparent translational initiation site at nucleotide positions 54–56 and ending at the stop codon found at nucleotide positions 909–911 (FIG. 189; SEQ ID NO:271). The predicted polypeptide precursor (FIG. 190, SEQ ID NO:272) is 285 amino acids long. PRO1360 has a calculated molecular weight of approximately 31,433 daltons and an estimated pI of approximately 7.32. Clone DNA59488-1603 was deposited with the ATCC on Aug. 25, 1998 and is assigned ATCC deposit no. 203157.

An analysis of the Dayhoff database (version 35.45 SwissProt 35), using a WU-BLAST2 sequence alignment analysis of the full-length sequence shown in FIG. 190 (SEQ ID NO:272), revealed sequence identity between the PRO1360 amino acid sequence and the following Dayhoff sequences: UN51_CAEEL, YD4B_SCHPO, AF000634_1, GFO_ZYMMO, YE1J_SCHPO, D86566_1, ZMGFO_1, S76976, PPSA_SYNY3, and CEF28B1_4.

Example 84

Isolation of cDNA Clones Encoding Human PRO1029

Use of the signal sequence algorithm described in Example 3 above allowed identification of an EST cluster sequence from the Incyte database, designated 18763. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57854.

In light of an observed sequence homology between the DNA57854 consensus sequence and an EST sequence encompassed within the Merck EST clone no. T98880, the Merck EST clone T98880 was purchased and the cDNA insert was obtained and sequenced. It was found that this insert encoded a full-length protein. The sequence of this cDNA insert is shown in FIG. 191 and is herein designated as DNA59493-1420.

Clone DNA59493-1420 contains a single open reading frame with an apparent translational initiation site at nucleotide positions 39–41 and ending at the stop codon at nucleotide positions 297–299 (FIG. 191). The predicted polypeptide precursor is 86 amino acids long (FIG. 192). The full-length PRO1029 protein shown in FIG. 192 has an estimated molecular weight of about 9,548 daltons and a pI of about 8.52. Analysis of the full-length PRO1029 sequence shown in FIG. 192 (SEQ ID NO:274) evidences the presence of the following: a signal peptide from about amino acid 1 to about amino acid 19, an amino acid block having homology to bacterial rhodopsins retinal binding site protein from about amino acid 50 to about amino acid 61, a prenyl group binding site from about amino acid 83 to about amino acid 86 and a potential N-glycosylation site from about amino acid 45 to about amino acid 48. Clone DNA59493-1420 has been deposited with ATCC on Jul. 1, 1998 and is assigned ATCC deposit no. 203050, An analysis of the Dayhoff database (version 35.45 SwissProt 35), using a WU-BLAST2 sequence alignment analysis of the full-length sequence shown in FIG. 192 (SEQ ID NO:274), evidenced significant homology between the PRO1029 amino acid sequence and the following Dayhoff sequences: S66088, AF031815_1, MM4A6L_1, PSEIS52a-1, S17699 and P_R63635.

Example 85

Isolation of cDNA Clones Encoding Human PRO1139

Use of the signal sequence algorithm described in Example 3 above allowed identification of an EST cluster sequence from the Incyte database, designated 4461. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57312.

The DNA57312 consensus sequence included a 172 nucleotides long public EST (T62095, Merck/University of Washington public database). This EST clone, identified herein as a putative protein coding sequence, was purchased from Merck, and sequenced to provide the coding sequence of PRO1139 (FIG. 193). As noted before, the deduced amino acid sequence of DNA59497-1496 shows a significant sequence identity with the deduced amino acid sequence of HSOBRGRP_1. The full-length protein (FIG. 194) contains a putative signal peptide between amino acid residues 1 and about 28, and three putative transmembrane domains (approximate amino acid residues 33–52, 71–89, 98–120).

Example 86

Isolation of cDNA Clones Encoding Human PRO1309

An expressed sequence tag (EST) DNA database (LIFESEQ®, Incyte Pharmaceuticals, Palo Alto, Calif.) was searched and an EST was identified which showed homology to SLIT.

RNA for construction of cDNA libraries was isolated from human fetal brain tissue. The cDNA libraries used to isolate the cDNA clones encoding human PRO1309 were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI.

The cDNA libraries (prepared as described above), were screened by hybridization with a synthetic oligonucleotide probe derived from the above described Incyte EST sequence:
5'-TCCGTGCAGGGGGACGCCTTTCAGAAACTGC GCCGAGTTAAGGAAC-3' (SEQ ID NO:279).

A cDNA clone was isolated and sequenced in entirety. The entire nucleotide sequence of DNA59588-1571 is shown in FIG. 195 (SEQ ID NO:277). Clone DNA59588-1571 contains a single open reading frame with an apparent translational initiation site at nucleotide positions 720–722 and a stop codon at nucleotide positions 2286–2288 (FIG. 195; SEQ ID NO:277). The predicted polypeptide precursor is 522 amino acids long. The signal peptide is approximately at 1–34 and the transmembrane domain is at approximately 428–450 of SEQ ID NO:278. Clone DNA59588-1571 has been deposited with ATCC and is assigned ATCC deposit no. 203106. The full-length PRO1309 protein shown in FIG. 196 has an estimated molecular weight of about 58,614 daltons and a pI of about 7.42.

An analysis of the Dayhoff database (version 35.45 SwissProt 35), using a WU-BLAST2 sequence alignment analysis of the full-length sequence shown in FIG. 196 (SEQ ID NO:278), revealed sequence identity between the PRO1309 amino acid sequence and the following Dayhoff sequences: AB007876_1, GPV_MOUSE, ALS_RAT, P_R85889, LUM_CHICK, AB014462_1, PGS1_CANFA, CEM88_7, A58532 and GEN11209.

Example 87

Isolation of cDNA Clones Encoding Human PRO1028

Use of the signal sequence algorithm described in Example 3 above allowed identification of a certain EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA59603.

In light of an observed sequence homology between the DNA59603 sequence and an EST sequence contained within Incyte EST clone no. 1497725, the Incyte EST clone no. 1497725 was purchased and the cDNA insert was obtained and sequenced. It was found that the insert encoded a full-length protein. The sequence of this cDNA insert is shown in FIG. 197 and is herein designated as DNA59603-1419.

The entire nucleotide sequence of DNA59603-1419 is shown in FIG. 197 (SEQ ID NO:280). Clone DNA59603-1419 contains a single open reading frame with an apparent translational initiation site at nucleotide positions 21–23 and ending at the stop codon at nucleotide positions 612–614 (FIG. 197). The predicted polypeptide precursor is 197 amino acids long (FIG. 198). The full-length PRO1028 protein shown in FIG. 198 has an estimated molecular weight of about 20,832 daltons and a pI of about 8.74. Clone DNA59603-1419 has been deposited with the ATCC. Regarding the sequence, it is understood that the deposited clone contains the correct sequence, and the sequences provided herein are based on known sequencing techniques.

Analyzing the amino acid sequence of SEQ ID NO:281, the putative signal peptide is at about amino acids 1–19 of SEQ ID NO:281. An N-glycosylation site is at about amino acids 35–38 of SEQ ID NO:281. A C-type lectin domain is at about amino acids 108–117 of SEQ ID NO:281, indicating that PRO513 may be related to or be a lectin. The corresponding nucleotides of these amino acid sequences or others can be routinely determined given the sequences provided herein.

Example 88

Isolation of cDNA Clones Encoding Human PRO1027

Use of the signal sequence algorithm described in Example 3 above allowed identification of a certain EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56399.

In light of an observed sequence homology between the DNA56399 sequence and an EST sequence contained within Incyte EST clone no. 937605, the Incyte EST clone no. 937605 was purchased and the cDNA insert was obtained and sequenced. It was found that the insert encoded a full-length protein. The sequence of this cDNA insert is shown in FIG. 199 and is herein designated as DNA59605-1418.

The entire nucleotide sequence of DNA59605-1418 is shown in FIG. 199 (SEQ ID NO:282). Clone DNA59605-1418 contains a single open reading frame with an apparent translational initiation site at nucleotide positions 31–33 and ending at the stop codon at nucleotide positions 262–264 (FIG. 199). The predicted polypeptide precursor is 77 amino acids long (FIG. 200). The full-length PRO1027 protein shown in FIG. 200 has an estimated molecular weight of about 8,772 daltons and a pI of about 9.62. Clone DNA59605-1418 has been deposited with the ATCC. Regarding the sequence, it is understood that the deposited clone contains the correct sequence, and the sequences provided herein are based on known sequencing techniques.

Analyzing the amino acid sequence of SEQ ID NO:283, the putative signal peptide is at about amino acids 1–33 of SEQ ID NO:283. The type II fibronectin collagen-binding domain begins at about amino acid 30 of SEQ ID NO:283.

The corresponding nucleotides for these amino acid sequences and others can be routinely determined given the sequences provided herein. PRO1027 may be involved in tissue formation or repair.

The following Dayhoff designations appear to have some sequence identity with PRO1027: SFT2_YEAST; ATM3E9_2; A69826; YM16_MARPO; E64896; U60193_2; MTLRAJ205_1; MCU6031570; SPAS_SHIFL; and S54213.

Example 89

Isolation of cDNA Clones Encoding Human PRO1107

Use of the signal sequence algorithm described in Example 3 above allowed identification of a certain EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56402.

In light of an observed sequence homology between the DNA56402 sequence and an EST sequence contained within Incyte EST clone no. 3203694, the Incyte EST clone no. 3203694 was purchased and the cDNA insert was obtained and sequenced. It was found that the insert encoded a full-length protein. The sequence of this cDNA insert is shown in FIG. 201 and is herein designated as DNA59606-1471.

The entire nucleotide sequence of DNA59606-1471 is shown in FIG. 201 (SEQ ID NO:284). Clone DNA59606-1471 contains a single open reading frame with an apparent translational initiation site at nucleotide positions 244–246 and ending at the stop codon at nucleotide positions 1675–1677 of SEQ ID NO:284 (FIG. 201). The predicted polypeptide precursor is 477 amino acids long (FIG. 202). The full-length PRO1107 protein shown in FIG. 202 has an estimated molecular weight of about 54,668 daltons and a pI of about 6.33. Clone DNA59606-1471 has been deposited with ATCC on Jun. 9, 1998. It is understood that the deposited clone has the actual nucleic acid sequence and that the sequences provided herein are based on known sequencing techniques.

Analysis of the amino acid sequence of the full-length PRO1107 polypeptide suggests that it possesses significant sequence similarity to phosphodiesterase I/nucleotide phyrophosphatase, human insulin receptor tyrosine kinase inhibitor, alkaline phosphodiesterase and autotaxin, thereby indicating that PRO1107 may have at least one or all of the activities of these proteins, and that PRO1107 is a novel phosphodiesterase. More specifically, an analysis of the Dayhoff database (version 35.45 SwissProt 35) evidenced sequence identity between the PRO1107 amino acid sequence and at least the following Dayhoff sequences: AF005632_1, P_R79148, RNU78787_1, AF060218_4, A57080 and HUMATXT_1.

Example 90

Isolation of cDNA Clones Encoding Human PRO1140

Use of the signal sequence algorithm described in Example 3 above allowed identification of a single Incyte EST sequence, Incyte cluster sequence No. 135917. This sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained therefrom is herein designated DNA56416.

In light of an observed sequence homology between DNA56416 and an EST sequence contained within Incyte EST clone no. 3345705, Incyte EST clone no. 3345705 was obtained and its insert sequenced. It was found that the insert encoded a full-length protein The sequence, designated herein as DNA59607-1497, which is shown in FIG. 203, is the full-length DNA sequence for PRO1140. Clone DNA59607-1497 was deposited with the ATCC on Jun. 9, 1998, and is assigned ATCC deposit no. 209946.

The entire nucleotide sequence of DNA59607-1497 is shown in FIG. 203 (SEQ ID NO:286). Clone DNA59607-1497 contains a single open reading frame with an apparent translational initiation site at nucleotide positions 210–212 and ending at the stop codon at nucleotide positions 975–977 (FIG. 203). The predicted polypeptide precursor is 255 amino acids long (FIG. 204). The full-length PRO1140 protein shown in FIG. 204 has an estimated molecular weight of about 29,405 daltons and a pI of about 7.64. Analysis of the full-length PRO1140 sequence shown in FIG. 204 (SEQ ID NO:287) evidences the presence of three transmembrane domains at about amino acids 101 to 118, 141 to 161 and 172 to 191.

Analysis of the amino acid sequence of the full-length PRO1140 polypeptide using the Dayhoff database (version 35.45 SwissProt 35) evidenced homology between the PRO1140 amino acid sequence and the following Dayhoff sequences: AF023602_1, AF000368_1, CIN3_RAT, AF003373_1, GEN13279, and AF003372_1.

Clone DNA59607-1497 was deposited with the ATCC on Jun. 9, 1998, and is assigned ATCC deposit no. 209946.

Example 91

Isolation of cDNA Clones Encoding Human PRO1106

Use of the signal sequence algorithm described in Example 3 above allowed identification of a single Incyte EST sequence. This sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, Univ. of Washington, Seattle, Wash.). The consensus sequence obtained therefrom is herein designated DNA56423.

In light of an observed sequence homology between DNA56423 and an EST sequence contained within Incyte EST clone no. 1711247, Incyte EST clone no. 1711247 was obtained and its insert sequenced. It was found that the insert encoded a full-length protein The sequence, designated herein as DNA59609-1470, which is shown in FIG. 205, is the full-length DNA sequence for PRO1106. Clone DNA59609-1470 was deposited with the ATCC on Jun. 9, 1998, and is assigned ATCC deposit no. 209963.

The entire nucleotide sequence of DNA59609-1470 is shown in FIG. 205 (SEQ ID NO:288). Clone DNA59609-1470 contains a single open reading frame with an apparent translational initiation site at nucleotide positions 61–63 and ending at the stop codon at nucleotide positions 1468–1470 of SEQ ID NO:288 (FIG. 205). The predicted polypeptide precursor is 469 amino acids long (FIG. 206). The full-length PRO1106 protein shown in FIG. 206 has an estimated molecular weight of about 52,689 daltons and a pI of about 8.68. It is understood that the skilled artisan can construct the polypeptide or nucleic acid encoding therefor to exclude any one or more of all of these domains. For example, the transmembrane domain region(s) and/or either of the amino terminal or carboxyl end can be excluded. Clone DNA59609-1470 has been deposited with ATCC on Jun. 9, 1998. It is understood that the deposited clone has the actual nucleic acid sequence and that the sequences provided herein are based on known sequencing techniques.

Analysis of the amino acid sequence of the full-length PRO1106 polypeptide suggests that it possesses significant sequence similarity to the peroxisomal ca-dependent solute carrier, thereby indicating that PRO1106 may be a novel transporter. More specifically, an analysis of the Dayhoff database (version 35.45 SwissProt 35) evidenced sequence identity between the PRO1106 amino acid sequence and at least the following Dayhoff sequences, AF004161_1, IG002N01_25, GDC_BOVIN and BT1_MAIZE.

Example 92

Isolation of cDNA Clones Encoding Human PRO1291

Use of the signal sequence algorithm described in Example 3 above allowed identification of an EST cluster sequence from the Incyte database, designated 120480. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56425.

In light of an observed sequence homology between the DNA56425 sequence and an EST sequence encompassed within the Incyte EST clone no. 2798803, the Incyte EST clone 2798803 was purchased and the cDNA insert was obtained and sequenced. It was found that this insert encoded a full-length protein. The sequence of this cDNA insert is shown in FIG. 207 and is herein designated as DNA59610-1556.

Clone DNA59610-1556 contains a single open reading frame with an apparent translational initiation site at nucleotide positions 61–63 and ending at the stop codon at nucleotide positions 907–909 (FIG. 207). The predicted polypeptide precursor is 282 amino acids long (FIG. 208). The full-length PRO1291 protein shown in FIG. 208 has an estimated molecular weight of about 30,878 daltons and a pI of about 5.27. Analysis of the full-length PRO1291 sequence shown in FIG. 208 (SEQ ID NO:291) evidences the presence of the following: a signal peptide from about amino acid 1 to about amino acid 28, a transmembrane domain from about amino acid 258 to about amino acid 281 and potential N-glycosylation sites from about amino acid 112 to about amino acid 115, from about amino acid 160 to about amino acid 163, from about amino acid 190 to about amino acid 193, from about amino acid 196 to about amino acid 199, from about amino acid 205 to about amino acid 208, from about amino acid 216 to about amino acid 219 and from about amino acid 220 to about amino acid 223. Clone DNA59610-1556 has been deposited with ATCC on Jun. 16, 1998 and is assigned ATCC deposit no. 209990.

An analysis of the Dayhoff database (version 35.45 SwissProt 35), using a WU-BLAST2 sequence alignment analysis of the full-length sequence shown in FIG. 208 (SEQ ID NO:291), evidenced significant homology between the PRO1291 amino acid sequence and the following Dayhoff sequences: HSU90552_1, HSU90144_1, AF033107_1, HSB73_1, HSU90142_1, GGCD80_1, P_W34452, MOG_MOUSE, B39371 and P_R71360.

Example 93

Isolation of cDNA Clones Encoding Human PRO1105

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56430.

In light of an observed sequence homology between the DNA56430 sequence and an EST sequence encompassed within the Incyte EST clone no. 1853047, the Incyte EST clone 1853047 was purchased and the cDNA insert was obtained and sequenced. It was found that this insert encoded a full-length protein. The sequence of this cDNA insert is shown in FIG. 209 and is herein designated as DNA59612-1466.

The entire nucleotide sequence of DNA59612-1466 is shown in FIG. 209 (SEQ ID NO:292). Clone DNA59612-

1466 contains a single open reading frame with an apparent translational initiation site at nucleotide positions 28–30 and ending at the stop codon at nucleotide positions 568–570 of SEQ ID NO:292 (FIG. 209). The predicted polypeptide precursor is 180 amino acids long (FIG. 210). The full-length PRO1105 protein shown in FIG. 210 has an estimated molecular weight of about 20,040 daltons and a pI of about 8.35. Clone DNA59612-1466 has been deposited with the ATCC on Jun. 9, 1998. It is understood that the deposited clone has the actual nucleic acid sequence and that the sequences provided herein are based on known sequencing techniques.

Analyzing FIG. 210, a signal peptide is at about amino acids 1–19 of SEQ ID NO:293 and transmembrane domains are shown at about amino acids 80–99 and 145–162 of SEQ ID NO:293. It is understood that the skilled artisan could form a polypeptide with all of or any combination or individual selection of these regions. It is also understood that the corresponding nucleic acids can be routinely identified and prepared based on the information provided herein.

Example 94

Isolation of cDNA Clones Encoding Human PRO511

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56434.

In light of an observed sequence homology between the DNA56434 sequence and an EST sequence encompassed within the Incyte EST clone no. 1227491, the Incyte EST clone 1227491 was purchased and the cDNA insert was obtained and sequenced. It was found that this insert encoded a full-length protein. The sequence of this cDNA insert is shown in FIG. 211 and is herein designated as DNA59613-1417.

The entire nucleotide sequence of DNA59613-1417 is shown in FIG. 211 (SEQ ID NO:294). Clone DNA59613-1417 contains a single open reading frame with an apparent translational initiation site at nucleotide positions 233–235 and ending at the stop codon at nucleotide positions 944–946 (FIG. 211). The predicted polypeptide precursor is 237 amino acids long (FIG. 212). The full-length PRO511 protein shown in FIG. 212 has an estimated molecular weight of about 25,284 daltons and a pI of about 5.74. Clone DNA59613-1417 has been deposited with the ATCC. Regarding the sequence, it is understood that the deposited clone contains the correct sequence, and the sequences provided herein are based on known sequencing techniques.

Analyzing the amino acid sequence of SEQ ID NO:295, the putative signal peptide is at about amino acids 1–25 of SEQ ID NO:295. The N-glycosylation sites are at about amino acids 45–48, 73–76, 107–110, 118–121, 132–135, 172–175, 175–178 and 185–188 of SEQ ID NO:295. An arthropod defensins conserved region is at about amino acids 176–182 of SEQ ID NO:295. A kringle domain begins at about amino acid 128 of SEQ ID NO:295 and a ly-6/u-PAR domain begins at about amino acid 6 of SEQ ID NO:295. The corresponding nucleotides of these amino acid sequences and others can be routinely determined given the sequences provided herein.

The designations appearing in a Dayhoff database with which PRO511 has some sequence identity are as follows: SSC20F10_1; SF041083; P_W26579; S44208; JC2394; PSTA_DICDI; A27020; S59310; RAG1_RABIT; and MUSBALBC11.

Example 95

Isolation of cDNA Clones Encoding Human PRO1104

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56446.

In light of an observed sequence homology between the DNA56446 sequence and an EST sequence encompassed within the Incyte EST clone no. 2837496, the Incyte EST clone 2837496 was purchased and the cDNA insert was obtained and sequenced. It was found that this insert encoded a full-length protein. The sequence of this cDNA insert is shown in FIG. 213 and is herein designated as DNA59616-1465.

The entire nucleotide sequence of DNA59616-1465 is shown in FIG. 213 (SEQ ID NO:296). Clone DNA59616-1465 contains a single open reading frame with an apparent translational initiation site at nucleotide positions 109–111 and ending at the stop codon at nucleotide positions 1132–1134 of SEQ ID NO:296 (FIG. 213). The predicted polypeptide precursor is 341 amino acids long (FIG. 214). The full-length PRO1104 protein shown in FIG. 214 has an estimated molecular weight of about 36,769 daltons and a pI of about 9.03. Clone DNA59616-1465 has been deposited with ATCC on Jun. 16, 1998. It is understood that the deposited clone has the actual nucleic acid sequence and that the sequences provided herein are based on known sequencing techniques.

Analyzing FIG. 214, a signal peptide is at about amino acids 1–22 of SEQ ID NO:297. N-myristoylation sites are at about amino acids 4146, 110–115, 133–138, 167–172 and 179–184 of SEQ ID NO:297.

Example 96

Isolation of cDNA Clones Encoding Human PRO1100

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.).

In light of an observed sequence homology between the obtained consensus sequence and an EST sequence encompassed within the Incyte EST clone no. 2305379, the Incyte EST clone 2305379 was purchased and the cDNA insert was obtained and sequenced. It was found that this insert encoded a full-length protein. The sequence of this cDNA insert is shown in FIG. 215 and is herein designated as DNA59619-1464.

The entire nucleotide sequence of DNA59619-1464 is shown in FIG. 215 (SEQ ID NO:298). Clone DNA59619-1464 contains a single open reading frame with an apparent translational initiation site at nucleotide positions 33–35 and ending at the stop codon at nucleotide positions 993–995 of SEQ ID NO:298 (FIG. 215). The predicted polypeptide precursor is 320 amino acids long (FIG. 216). The full-length PRO1100 protein shown in FIG. 216 has an estimated molecular weight of about 36,475 daltons and a pI of about 7.29. Clone DNA59619-1464 has been deposited with ATCC on Jul. 1, 1998. It is understood that the deposited clone has the actual nucleic acid sequence and that the sequences provided herein are based on known sequencing techniques.

Upon analyzing SEQ ID NO:299, the approximate locations of the signal peptide, the transmembrane domains, an N-glycosylation site, an N-myristoylation site, a CUB domain and an amiloride-sensitive sodium channel domain are present. It is believed that PRO1100 may function as a channel. The corresponding nucleic acids for these amino acids and others can be routinely determined given SEQ ID NO:299.

Example 97

Isolation of cDNA Clones Encoding Human PRO836

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (Lifeseq@, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained is herein designated DNA56453.

In light of an observed sequence homology between the DNA56453 consensus sequence and an EST sequence encompassed within the Incyte EST clone no. 2610075, the Incyte EST clone 2610075 was purchased and the cDNA insert was obtained and sequenced. It was found that this insert encoded a full-length protein.

The sequence of this cDNA insert is shown in FIG. 217 and is herein designated as DNA59620-1463.

The entire nucleotide sequence of DNA59620-1463 is shown in FIG. 217 (SEQ ID NO:300). Clone DNA59620-1463 contains a single open reading frame with an apparent translational initiation site at nucleotide positions 65–67 and ending at the stop codon at nucleotide positions 1448–1450 of SEQ ID NO:300 (FIG. 217). The predicted polypeptide precursor is 461 amino acids long (FIG. 218). The full-length PRO836 protein shown in FIG. 218 has an estimated molecular weight of about 52,085 daltons and a pI of about 5.36.

Analysis of the full-length PRO836 sequence shown in FIG. 218 (SEQ ID NO:301) evidences the presence of the following: a signal peptide, N-glycosylation sites, N-myristoylation sites, a domain conserved in the YJL126w/YLR351c/yhcX family of proteins, and a region having sequence identity with SLS1. Clone DNA59620-1463 has been deposited with ATCC on Jun. 16, 1998. It is understood that the deposited clone has the actual nucleic acid sequence and that the sequences provided herein are based on known sequencing techniques.

Analysis of the amino acid sequence of the full-length PRO836 polypeptide suggests that it possesses some sequence similarity to SLS1, thereby indicating that PRO836 may be involved in protein translocation of the ER. More specifically, an analysis of the Dayhoff database (version 35.45 SwissProt 35) evidenced some homology between the PRO836 amino acid sequence and at least the following Dayhoff sequences, S58132, SPBC3B9_1, S66714, CRU40057_1 and IMA_CAEEL.

EXAMPLE 98

Isolation of cDNA Clones Encoding Human PRO1141

Use of the signal sequence algorithm described in Example 3 above allowed identification of an EST cluster sequence from the Incyte database, designated 11873. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56518.

In light of an observed sequence homology between the DNA56518 consensus sequence and an EST sequence encompassed within the Incyte EST clone no. 2679995, the Incyte EST clone 2679995 was purchased and the cDNA insert was obtained and sequenced. It was found that this insert encoded a full-length protein.

The sequence of this cDNA insert is shown in FIG. 219 and is herein designated as DNA59625-1498.

Clone DNA59625-1498 contains a single open reading frame with an apparent translational initiation site at nucleotide positions 204–206 and ending at the stop codon at nucleotide positions 945–947 (FIG. 219). The predicted polypeptide precursor is 247 amino acids long (FIG. 220). The full-length PRO1141 protein shown in FIG. 220 has an estimated molecular weight of about 26,840 daltons and a pI of about 8.19. Analysis of the full-length PRO1141 sequence shown in FIG. 220 (SEQ ID NO:303) evidences the presence of the following: a signal peptide from about amino acid 1 to about amino acid 19 and transmembrane domains from about amino acid 38 to about amino acid 57, from about amino acid 67 to about amino acid 83, from about amino acid 117 to about amino acid 139 and from about amino acid 153 to about amino acid 170. Clone DNA59625-1498 has been deposited with ATCC on Jun. 16, 1998 and is assigned ATCC deposit no. 209992.

An analysis of the Dayhoff database (version 35.45 SwissProt 35), using a WU-BLAST2 sequence alignment analysis of the full-length sequence shown in FIG. 220 (SEQ ID NO:303), evidenced significant homology between the PRO1141 amino acid sequence and the following Dayhoff sequences: CEVF36H2L_2, PCRB7PRJ_1, AB000506_1, LEU95008_1, MRU87980_15, YIGM_*ECOLI*, STU65700_1, GHU62778_1, CYST_SYNY3 and AF009567_1.

Example 99

Isolation of cDNA Clones Encoding Human PRO1132

A consensus DNA sequence was assembled relative to other EST sequences using phrap as described in Example 1 above. This consensus sequence is designated herein as DNA35934. Based on the DNA35934 consensus sequence, oligonucleotides were synthesized: 1) to identify by PCR a cDNA library that contained the sequence of interest, and 2) for use as probes to isolate a clone of the full-length coding sequence for PRO1132.

PCR primers (forward and reverse) were synthesized:

forward PCR primer: 5'-TCCTGTGACCACCCCTCTAACACC-3' (SEQ ID NO:310) and reverse PCR primer: 5'-CTGGAACATCTGCTGCCCAGATTC-3' (SEQ ID NO:311).

Additionally, a synthetic oligonucleotide hybridization probe was constructed from the consensus sequence which had the following nucleotide sequence:

5'-GTCGGATGACAGCAGCAGCCGCATCATCAATG GATCCGACTGCGATATGC-3' (SEQ ID NO:312).

In order to screen several libraries for a source of a full-length clone, DNA from the libraries was screened by PCR amplification with the PCR primer pair identified above. A positive library was then used to isolate clones encoding the PRO1132 gene using the probe oligonucleotide and one of the PCR primers. RNA for construction of the cDNA libraries was isolated from human fetal kidney.

DNA sequencing of the clones isolated as described above gave the full-length DNA sequence for PRO1132 and the derived protein sequence for PRO1132.

The entire nucleotide sequence of PRO1132 is shown in FIG. 225 (SEQ ID NO:308). Clone DNA59767-1489 contains a single open reading frame with an apparent translational initiation site at nucleotide positions 354–356 and a stop codon at nucleotide positions 1233–1235 (FIG. 225; SEQ ID NO:308). The predicted polypeptide precursor is 293 amino acids long. The signal peptide is at about amino acids 1–22 and the histidine active site is at about amino acids 104–109 of SEQ ID NO:309. Clone DNA59767-1489 has been deposited with ATCC (having the actual sequence rather than representations based on sequencing techniques as presented herein) and is assigned ATCC deposit no. 203108. The full-length PRO132 protein shown in FIG. 226 has an estimated molecular weight of about 32,020 daltons and a pI of about 8.7.

An analysis of the Dayhoff database (version 35.45 SwissProt 35), using a WU-BLAST2 sequence alignment analysis of the full-length sequence shown in FIG. 226 (SEQ ID NO:309), revealed sequence identity between the PRO1132 amino acid sequence and the following Dayhoff sequences: SSU76256_1, P_W10694, MMAE000663_6, AF013988_1, U66061_8, MMAE000665_2, MMAE00066415, MMAE00066414, MMAE000665_4 and MMAE00066412.

Example 100

Isolation of cDNA Clones Encoding Human NL7 (PRO1346)

A single EST sequence (#1398422) was found in the LIFESEQ® database as described in Example 1 above. This EST sequence was renamed as DNA45668. Based on the DNA45668 sequence, oligonucleotides were synthesized: 1) to identify by PCR a cDNA library that contained the sequence of interest, and 2) for use gas probes to isolate a clone of the full-length coding sequence for NL7. PCR primers (forward and reverse) were synthesized:

forward PCR primer: 5'-CACACGTCCAACCTCAATGGGCAG-3' (SEQ ID NO:315)

reverse PCR primer: 5'-GACCAGCAGGGCCAAGGACAAGG-3' (SEQ ID NO:316)

Additionally, a synthetic oligonucleotide hybridization probe was constructed from the consensus DNA45668 sequence which had the following nucleotide sequence:

Hybridization Probe:

5'-GTTCTCTGAGATGAAGATCCGGCCGGTCCGGG AGTACCGCTTAG-3' (SEQ ID NO:317)

In order to screen several libraries for a source of a full-length clone, DNA from the libraries was screened by PCR amplification with the PCR primer pair identified above. A positive library was then used to isolate clones encoding the NL7 gene using the probe oligonucleotide and one of the PCR primers. RNA for construction of the cDNA libraries was isolated from a human fetal kidney library (LIB227).

PCR primers (forward and 2 reverse) were synthesized:

```
forward PCR primer    5'-ATGCAGGCCAAGTACAGCAGCAC-3'     (SEQ ID NO:321);
reverse PCR primer 1  5'-CATGCTGACGACTTCCTGCAAGC-3'     (SEQ ID NO:322); and
reverse PCR primer 1  5'-CCACACAGTCTCTGCTTCTTGGG-3'     (SEQ ID NO:323)
```

DNA sequencing of the clones isolated as described above gave the full-length DNA sequence for NL7 (designated herein as DNA59776-1600 [FIG. 227, SEQ ID NO:313]) and the derived protein sequence for NL7 (PRO1346).

The entire coding sequence of NL7 (PRO1346) is shown in FIG. 227 (SEQ ID NO:313). Clone DNA59776-1600 contains a single open reading frame with an apparent translational initiation site at nucleotide positions 1–3 and an apparent stop codon at nucleotide positions 1384–1386. The predicted polypeptide precursor is 461 amino acids long. The protein contains an apparent type II transmembrane domain at amino acid positions from about 31 to about 50; fibrinogen beta and gamma chains C-terminal domain signature starting at about amino acid position 409, and a leucine zipper pattern starting at about amino acid positions 140, 147, 154 and 161, respectively. Clone DNA59776-1600 has been deposited with ATCC and is assigned ATCC deposit no. 203128. The full-length NL7 protein shown in FIG. 228 has an estimated molecular weight of about 50,744 daltons and a pI of about 6.38.

Based on a WU-BLAST2 sequence alignment analysis (using the WU-BLAST2 computer program) of the full-length sequence, NL7 shows significant amino acid sequence identity to a human microfibril-associated glycoprotein (1 MFA4_HUMAN); to known TIE-2 ligands and ligand homologues, ficolin, serum lectin and TGF-1 binding protein.

Example 101

Isolation of cDNA Clones Encoding Human PRO1131

A cDNA sequence isolated in the amylase screen described in Example 2 above is herein designated DNA43546 (see FIG. 231; SEQ ID NO:320). The DNA43546 sequence was then compared to a variety of expressed sequence tag (EST) databases which included public EST databases (e.g., GenBank) and a proprietary EST DNA database (LIFESEQ™, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated DNA45627.

Based on the DNA45627 sequence, oligonucleotide probes were generated and used to screen a human library prepared as described in paragraph 1 of Example 2 above. The cloning vector was pRK5B (pRK5B is a precursor of pRK5D that does not contain the SfiI site; see, Holmes et al., Science 253:1278–1280 (1991)), and the cDNA size cut was less than 2800 bp.

PCR primers (forward and 2 reverse) were synthesized:

Additionally, a synthetic oligonucleotide hybridization probe was constructed from the DNA45627 sequence which had the following nucleotide sequence:
Hybridization Probe
5'-ATGCTGGATGATGATGGGGACACCACCATGAG CCTGCATT-3' (SEQ ID NO:324).

In order to screen several libraries for a source of a full-length clone, DNA from the libraries was screened by PCR amplification with the PCR primer pair identified above. A positive library was then used to isolate clones encoding the PRO1131 gene using the probe oligonucleotide and one of the PCR primers.

A full length clone was identified that contained a single open reading frame with an apparent translational initiation site at nucleotide positions 144–146, and a stop signal at nucleotide positions 984–986 (FIG. 229; SEQ ID NO:318). The predicted polypeptide precursor is 280 amino acids long, has a calculated molecular weight of approximately 31,966 daltons and an estimated pI of approximately 6.26. The transmembrane domain sequence is at about 49–74 of SEQ ID NO:319 and the region having sequence identity with LDL receptors is about 50–265 of SEQ ID NO:319. PRO1131 contains potential N-linked glycosylation sites at amino acid positions 95–98 and 169–172 of SEQ ID NO:319. Clone DNA59777-1480 has been deposited with the ATCC and is assigned ATCC deposit no. 203111.

An analysis of the Dayhoff database (version 35.45 SwissProt 35), using a WU-BLAST2 sequence alignment analysis of the full-length sequence shown in FIG. 230 (SEQ ID NO:319), evidenced some sequence identity between the PRO1131 amino acid sequence and the following Dayhoff sequences: AB01070_1, I49053, I49115, RNU56863_1, LY4A_MOUSE, I55686, MMU56404_1, I49361, AF030313_1 and MMU09739_1.

Example 102

Isolation of cDNA Clones Encoding Human PRO1281

A consensus DNA sequence was assembled relative to other EST sequences using phrap as described in Example 1 above. This consensus sequence is designated herein as DNA35720. Based on the DNA35720 sequence, oligonucleotides were synthesized: 1) to identify by PCR a cDNA library that contained the sequence of interest, and 2) for use as probes to isolate a clone of the full-length coding sequence for PRO1281.

PCR primers (forward and reverse) were synthesized:

```
forward PCR primers:
5'-TGGAAGGCTGCCGCAACGACAATC-3'    (SEQ ID NO:327);

5'-CTGATGTGGCCGATGTTCTG-3'         (SEQ ID NO:328);
```

-continued and

5'-ATGGCTCAGTGTGCAGACAG-3'      (SEQ ID NO:329).

reverse PCR primers:
5'-GCATGCTGCTCCGTGAAGTAGTCC-3'  (SEQ ID NO:330);

and

5'-ATGCATGGGAAAGAAGGCCTGCCC-3'  (SEQ ID NO:331).

Additionally, a synthetic oligonucleotide hybridization probe was constructed from the DNA35720 sequence which had the following nucleotide sequence:
Hybridization Probe:
5'-TGCACTGGTGACCACGAGGGGGTGCACTATAG CCATCTGGAGCTGAG-3' (SEQ ID NO:332).

In order to screen several libraries for a source of a full-length clone, DNA from the libraries was screened by PCR amplification with the PCR primer pairs identified above. A positive library was then used to isolate clones encoding the PRO1281 gene using the probe oligonucleotide and one of the PCR primers. RNA for construction of the cDNA libraries was isolated human fetal liver.

DNA sequencing of the clones isolated as described above gave the full-length DNA sequence for PRO1281 (designated herein as DNA59820-1549 [FIG. 232, SEQ ID NO:325]; and the derived protein sequence for PRO1281.

The entire coding sequence of PRO1281 is shown in FIG. 232 (SEQ ID NO:325). Clone DNA59820-1549 contains a single open reading frame with an apparent translational initiation site at nucleotide positions 228–230 and an apparent stop codon at nucleotide positions 2553–2555. The predicted polypeptide precursor is 775 amino acids long. The full-length PRO1281 protein shown in FIG. 233 has an estimated molecular weight of about 85,481 daltons and a pI of about 6.92. Additional features include a signal peptide at about amino acids 1–15; and potential N-glycosylation sites at about amino acids 138–141 and 361–364.

An analysis of the Dayhoff database (version 35.45 SwissProt 35), using a WU-BLAST2 sequence alignment analysis of the full-length sequence shown in FIG. 233 (SEQ ID NO:326), revealed some sequence identity between the PRO1281 amino acid sequence and the following Dayhoff sequences: S44860, CET24D1__1, CEC38H2__3, CAC2__HAECO, B3A2__HUMAN, S22373, CEF38A3__2, CEC34F6__2, CEC34F6__3, and CELT22B11__3.

Clone DNA59820-1549 has been deposited with ATCC and is assigned ATCC deposit no. 203129.

Example 103

Isolation of cDNA Clones Encoding Human PRO1064

A cDNA sequence isolated in the amylase screen described in Example 2 above was found, by the WU-BLAST2 sequence alignment computer program, to have no significant sequence identity to any known human protein. This cDNA sequence is herein designated DNA45288. The DNA45288 sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., Methods in Enzymology, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence is herein designated DNA48609. Oligonucleotide primers based upon the DNA48609 sequence were then synthesized and employed to screen a human fetal kidney cDNA library which resulted in the identification of the DNA59827-1426 clone shown in FIG. 234. The cloning vector was pRK5B (pRK5B is a precursor of pRK5D that does not contain the SfiI site; see, Holmes et al., Science, 253:1278–1280 (1991)), and the cDNA size cut was less than 2800 bp.

The oligonucleotide probes employed were as follows:

forward PCR primer  5'-CTGAGACCCTGCAGCACCATCTG-3'   (SEQ ID NO:336)

reverse PCR primer  5'-GGTGCTTCTTGAGCCCCACTTAGC-3'  (SEQ ID NO:337)

Additionally, a synthetic oligonucleotide hybridization probe was constructed from the consensus DNA48609 sequence which had the following nucleotide sequence
Hybridization Probe
5'-AATCTAGCTTCTCCAGGACTGTGGTCGCCCCGT CCGCTGT-3' (SEQ ID NO:338)

A full length clone was identified that contained a single open reading frame with an apparent translational initiation site at nucleotide positions 532–534 and a stop signal at nucleotide positions 991–993 (FIG. 234, SEQ ID NO:333). The predicted polypeptide precursor is 153 amino acids long, has a calculated molecular weight of approximately 17,317 daltons and an estimated pI of approximately 5.17. Analysis of the full-length PRO1064 sequence shown in FIG. 235 (SEQ ID NO:334) evidences the presence of the following: a signal peptide from about amino acid 1 to about amino acid 24, a transmembrane domain from about amino acid 89 to about amino acid 110, an indole-3-glycerol phosphate synthase homology block from about amino acid 74 to about amino acid 105 and a Myb DNA binding domain protein repeat protein homology block from about amino acid 114 to about amino acid 137. Clone DNA59827-1426 has been deposited with ATCC on Aug. 4, 1998 and is assigned ATCC deposit no. 203089.

An analysis of the Dayhoff database (version 35.45 SwissProt 35), using a WU-BLAST2 sequence alignment analysis of the full-length sequence shown in FIG. 235 (SEQ ID NO:334), evidenced homology between the PRO1064 amino acid sequence and the following Dayhoff sequences: MMNP15PRO__1, BP187PLYH__1, CELF42G8__4, MMU58888__1, GEN14270, TUB8__SOLTU, RCN__MOUSE, HUMRBSY79__1, SESENODA__1 and A21467__1.

Example 104

Isolation of cDNA Clones Encoding Human PRO1379

A consensus DNA sequence was assembled relative to other EST sequences using phrap as described in Example 1 above. This consensus sequence is designated herein DNA45232. Based on the DNA45232 consensus sequence, oligonucleotides were synthesized: 1) to identify by PCR a cDNA library that contained the sequence of interest, and 2) for use as probes to isolate a clone of the full-length coding sequence for PRO1379.

PCR primers (forward and reverse) were synthesized:

```
forward PCR primer  5'-TGGACACCGTACCCTGGTATCTGC-3'  (SEQ ID NO:341)

reverse PCR primer  5'-CCAACTCTGAGGAGAGCAAGTGGC-3'  (SEQ ID NO:342)
```

Additionally, a synthetic oligonucleotide hybridization probe was constructed from the consensus DNA45232 sequence which had the following nucleotide sequence:
Hybridization Probe
5'-TGTATGTGCACACCCTCACCATCACCTCCAAGG GCAAGGAGAAC-3' (SEQ ID NO:343).

In order to screen several libraries for a source of a full-length clone, DNA from the libraries was screened by PCR amplification with the PCR primer pair identified above. A positive library was then used to isolate clones encoding the PRO1379 gene using the probe oligonucleotide and one of the PCR primers. RNA for construction of the cDNA libraries was isolated human fetal kidney tissue.

DNA sequencing of the clones isolated as described above gave the full-length DNA sequence for PRO1379 which is designated herein as DNA59828-1608 and shown in FIG. 237 (SEQ ID NO:339); and the derived protein sequence for PRO1379 (SEQ ID NO:340).

The entire coding sequence of PRO1379 is shown in FIG. 237 (SEQ ID NO:339). Clone DNA59828-1608 contains a single open reading frame with an apparent translational initiation site at nucleotide positions 10–12 and an apparent stop codon at nucleotide positions 1732–1734. The predicted polypeptide precursor is 574 amino acids long. The full-length PRO1379 protein shown in FIG. 238 has an estimated molecular weight of about 65,355 daltons and a pI of about 8.73. Additional features include a signal peptide at about amino acids 1–17 and potential N-glycosylation sites at about amino acids 160–163, 287–290, and 323–326.

An analysis of the Dayhoff database (version 35.45 SwissProt 35), using a WU-BLAST2 sequence alignment analysis of the full-length sequence shown in FIG. 238 (SEQ ID NO:340), revealed some homology between the PRO1379 amino acid sequence and the following Dayhoff sequences: YHY8_YEAST, AF040625_1, HP714394_1, and HIV18U45630_1.

Clone DNA59828-1608 has been deposited with ATCC and is assigned ATCC deposit no. 203158.

Example 105

Isolation of cDNA Clones Encoding Human PRO844

An expressed sequence tag (EST) DNA database (LIFESEQ™, Incyte Pharmaceuticals, Palo Alto, Calif.) was searched and an EST was identified which showed sequence identity with aLP. Based on the information and discoveries provided herein, the clone for this EST, Incyte clone no. 2657496 from a cancerous lung library was further examined.

DNA sequencing of the insert for this clone gave a sequence (herein designated as DNA59838-1462; SEQ ID NO:344) which includes the full-length DNA sequence for PRO844 and the derived protein sequence for PRO844.

The entire nucleotide sequence of DNA59838-1462 is shown in FIG. 239 (SEQ ID NO:344). Clone DNA59838-1462 contains a single open reading frame with an apparent translational initiation site at nucleotide positions 5–7 and ending at the stop codon at nucleotide positions 338–340 of SEQ ID NO:344 (FIG. 239). The predicted polypeptide precursor is 111 amino acids long (FIG. 240). The full-length PRO844 protein shown in FIG. 240 has an estimated molecular weight of about 12,050 daltons and a pI of about 5.45. Clone UNQ544 DNA59838-1462 has been deposited with ATCC on Jun. 16, 1998. It is understood that the deposited clone has the actual nucleic acid sequence and that the sequences provided herein are based on known sequencing techniques.

Analysis of the amino acid sequence of the full-length PRO844 polypeptide suggests that it possesses significant sequence similarity to serine protease inhibitors, thereby indicating that PRO844 may be a novel proteinase inhibitor. More specifically, an analysis of the Dayhoff database (version 35.45 SwissProt 35) evidenced significant homology between the PRO844 amino acid sequence and at least the following Dayhoff sequences, ALK1_HUMAN, P_P82403, P_P82402, ELAF_HUMAN and P_P60950.

Example 106

Isolation of cDNA Clones Encoding Human PRO848

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55999.

In light of an observed sequence homology between the DNA55999 consensus sequence and an EST sequence encompassed within the Incyte EST clone no. 2768571, the Incyte EST clone 2768571 was purchased and the cDNA insert was obtained and sequenced. It was found that this insert encoded a full-length protein. The sequence of this cDNA insert is shown in FIG. 241 and is herein designated as DNA59839-1461.

The entire nucleotide sequence of DNA59839-1461 is shown in FIG. 241 (SEQ ID NO:346). Clone DNA59839-1461 contains a single open reading frame with an apparent translational initiation site at nucleotide positions 146–148 and ending at the stop codon at nucleotide positions 1946–1948 of SEQ ID NO:346 (FIG. 241). The predicted polypeptide precursor is 600 amino acids long (FIG. 242).

The full-length PRO848 protein shown in FIG. 242 has an estimated molecular weight of about 68,536 daltons. Clone DNA59839-1461 has been deposited with ATCC on Jun. 16, 1998. It is understood that the deposited clone has the actual nucleic acid sequence and that the sequences provided herein are based on known sequencing techniques.

Analysis of the amino acid sequence of the full-length PRO848 polypeptide suggests that it may be a novel sialyltransferase. More specifically, an analysis of the Dayhoff database (version 35.45 SwissProt 35) evidenced sequence identity between the PRO848 amino acid sequence and at least the following Dayhoff sequences, P_R78619 (GalNAc-alpha-2,6-sialyltransferase), CAAG5_CHICK (alpha-n-acetylgalactosamide alpha-2,6-sialyltransferase), HSU14550_1, CAG6_HUMAN and P_R63217 (human alpha-2,3-sialyltransferase).

Example 107

Isolation of cDNA Clones Encoding Human PRO1097

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56006.

In light of an observed sequence homology between the DNA56006 consensus sequence and an EST sequence encompassed within the Incyte EST clone no. 2408105, the Incyte EST clone 2408105 was purchased and the cDNA insert was obtained and sequenced. It was found that this insert encoded a full-length protein. The sequence of this cDNA insert is shown in FIG. 243 and is herein designated as DNA59841-1460.

The entire nucleotide sequence of DNA59841-1460 is shown in FIG. 243 (SEQ ID NO:348). Clone DNA59841-1460 contains a single open reading frame with an apparent translational initiation site at nucleotide positions 3–5 and ending at the stop codon at nucleotide positions 276–278 of SEQ ID NO:348 (FIG. 243). The predicted polypeptide precursor is 91 amino acids long (FIG. 244). The full-length PRO1097 protein shown in FIG. 244 has an estimated molecular weight of about 10,542 daltons and a pI of about 10.04. Clone DNA59841-1460 has been deposited with ATCC on Jul. 1, 1998. It is understood that the deposited clone has the actual nucleic acid sequence and that the sequences provided herein are based on known sequencing techniques.

Analyzing FIG. 244, the signal peptide is at about amino acids 1–20 of SEQ ID NO:349. The glycoprotease family protein domain starts at about amino acid 56, and the acyltransferase ChoActase/COT/CPT family peptide starts at about amino acid 49 of SEQ ID NO:349.

Example 108

Isolation of cDNA clones Encoding Human PRO1153

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56008.

In light of an observed sequence homology between the DNA56008 consensus sequence and an EST sequence encompassed within the Incyte EST clone no. 2472409, the Incyte EST clone 2472409 was purchased and the cDNA insert was obtained and sequenced. It was found that this insert encoded a full-length protein. The sequence of this cDNA insert is shown in FIG. 245 and is herein designated as DNA59842-1502. The full length clone shown in FIG. 245 contained a single open reading frame with an apparent translational initiation site at nucleotide positions 92–94 and ending at the stop codon found at nucleotide positions 683–685 (FIG. 245; SEQ ID NO:350). The predicted polypeptide precursor (FIG. 246, SEQ ID NO:351) is 197 amino acids long. PRO1153 has a calculated molecular weight of approximately 21,540 daltons and an estimated pI of approximately 8.31. Clone DNA59842-1502 has been deposited with ATCC and is assigned ATCC deposit no. 209982. It is understood that the correct and actual sequence is in the deposited clone while herein are present representations based on current sequencing techniques which may have minor errors.

Based on a WU-BLAST2 sequence alignment analysis (using the ALIGN computer program) of the full-length sequence, PRO1153 shows some amino acid sequence identity to the following Dayhoff designations: S57447; SOYHRGPC_1; S46965; P_P82971; VCPHEROPH_1; EXTN_TOBAC; MLCB2548_9; ANXA_RABIT; JC5437 and SSGP_VOLCA.

Example 109

Isolation of cDNA Clones Encoding Human PRO1154

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56025.

In light of an observed sequence homology between the DNA56025 consensus sequence and an EST sequence encompassed within the Incyte EST clone no. 2169375, the Incyte EST clone 2169375 was purchased and the cDNA insert was obtained and sequenced. It was found that this insert encoded a full-length protein. The sequence of this cDNA insert is shown in FIG. 247 and is herein designated as DNA59846-1503.

The full length clone shown in FIG. 247 contained a single open reading frame with an apparent translational initiation site at nucleotide positions 86–88 and ending at the stop codon found at nucleotide positions 2909–2911 (FIG. 247; SEQ ID NO:352). The predicted polypeptide precursor (FIG. 248, SEQ ID NO:353) is 941 amino acids long. PRO1154 has a calculated molecular weight of approximately 107,144 daltons and an estimated pI of approximately 6.26. Clone DNA59846-1503 has been deposited with ATCC and is assigned ATCC deposit no. 209978.

Based on a WU-BLAST2 sequence alignment analysis (using the ALIGN computer program) of the full-length sequence, PRO1154 shows sequence identity to at least the following Dayhoff designations: AB011097_1, AMPN_HUMAN, RNU76997_1, I59331, GEN14047, HSU62768_1, P_R51281, CET07F10_1, SSU66371_1, and AMPRE_HUMAN.

Example 110

Isolation of cDNA Clones Encoding Human PRO1181

Use of the signal sequence algorithm described in Example 3 above allowed identification of a single EST cluster sequence from the Incyte database, designated herein as 82468. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56029.

In light of an observed sequence homology between the DNA56029 consensus sequence and an EST sequence encompassed within the Incyte EST clone no. 2186536, the Incyte EST clone 2186536 was purchased and the cDNA insert was obtained and sequenced. It was found that this insert encoded a full-length protein. The sequence of this cDNA insert is shown in FIG. 249 and is herein designated as DNA59847-1511.

Clone DNA59847-1511 contains a single open reading frame with an apparent translational initiation site at nucleotide positions 17–19 and ending at the stop codon at nucleotide positions 1328–1330 (FIG. 249). The predicted polypeptide precursor is 437 amino acids long (FIG. 250). The full-length PRO1181 protein shown in FIG. 250 has an estimated molecular weight of about 46,363 daltons and a pI of about 6.22. Analysis of the full-length PRO1181 sequence shown in FIG. 250 (SEQ ID NO:355) evidences the presence of the following: a signal peptide from about amino acid 1 to about amino acid 15, potential N-glycosylation sites from about amino acid 46 to about amino acid 49, from about amino acid 189 to about amino acid 192 and from about amino acid 382 to about amino acid 385 and amino acid sequence blocks having homology to Ly-6/u-PAR domain proteins from about amino acid 287 to about amino acid 300 and from about amino acid 98 to about amino acid 111. Clone DNA59847-1511 has been deposited with ATCC on Aug. 4, 1998 and is assigned ATCC deposit no. 203098.

An analysis of the Dayhoff database (version 35.45 SwissProt 35), using a WU-BLAST2 sequence alignment analysis of the full-length sequence shown in FIG. 250 (SEQ ID NO:355), evidenced homology between the PRO1181 amino acid sequence and the following Dayhoff sequences: AF041083_1, P_W26579, RNMAGPIAN_1, CELT13C2_2, LMSAP2GN_1, S61882, CEF35C5_12, DP87_DICDI, GIU47631_1 and P_R07092.

Example 111

Isolation of cDNA Clones Encoding Human PRO1182

Use of the signal sequence algorithm described in Example 3 above allowed identification of a single EST cluster sequence from the Incyte database, designated herein as 146647. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56033.

In light of an observed sequence homology between the DNA56033 consensus sequence and an EST sequence encompassed within the Incyte EST clone no. 2595195, the Incyte EST clone 2595195 was purchased and the cDNA insert was obtained and sequenced. It was found that this insert encoded a full-length protein. The sequence of this cDNA insert is shown in FIG. 251 and is herein designated as DNA59848-1512.

Clone DNA59848-1512 contains a single open reading frame with an apparent translational initiation site at nucleotide positions 67–69 and ending at the stop codon at nucleotide positions 880–882 (FIG. 251). The predicted polypeptide precursor is 271 amino acids long (FIG. 252). The full-length PRO1182 protein shown in FIG. 252 has an estimated molecular weight of about 28,665 daltons and a pI of about 5.33. Analysis of the full-length PRO1182 sequence shown in FIG. 252 (SEQ ID NO:357) evidences the presence of the following: a signal peptide from about amino acid 1 to about amino acid 25, an amino acid block having homology to C-type lectin domain proteins from about amino acid 247 to about amino acid 256 and an amino acid sequence block having homology to C1q domain proteins from about amino acid 44 to about amino acid 77. Clone DNA59848-1512 has been deposited with ATCC on Aug. 4, 1998 and is assigned ATCC deposit no. 203088.

An analysis of the Dayhoff database (version 35.45 SwissProt 35), using a WU-BLAST2 sequence alignment analysis of the full-length sequence shown in FIG. 252 (SEQ ID NO:357), evidenced significant homology between the PRO1182 amino acid sequence and the following Dayhoff sequences: PSPD_BOVIN, CL43_BOVIN, CONG_BOVIN, P_W18780, P_R45005, P_R53257 and CELEGAP7_1.

Example 112

Isolation of cDNA Clones Encoding Human PRO1155

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56102.

In light of an observed sequence homology between the DNA56102 consensus sequence and an EST sequence encompassed within the Incyte EST clone no. 2858870, the Incyte EST clone 2858870 was purchased and the cDNA insert was obtained and sequenced. It was found that this insert encoded a full-length protein. The sequence of this cDNA insert is shown in FIG. 253 and is herein designated as DNA59849-1504.

The full length clone shown in FIG. 253 contained a single open reading frame with an apparent translational initiation site at nucleotide positions 158–160 and ending at the stop codon found at nucleotide positions 563–565 (FIG. 253; SEQ ID NO:358). The predicted polypeptide precursor (FIG. 254, SEQ ID NO:359) is 135 amino acids long. PRO1155 has a calculated molecular weight of approximately 14,833 daltons and an estimated pI of approximately 9.78. Clone DNA59849-1504 has been deposited with ATCC and is assigned ATCC deposit no. 209986. It is understood that the actual clone has the correct sequence whereas herein are only representations which are prone to minor sequencing errors.

Based on a WU-BLAST2 sequence alignment analysis (using the ALIGN computer program) of the full-length sequence, PRO1155 shows some amino acid sequence identity with the following Dayhoff designations: TKNK_BOVIN; PVB19x587_1; AF019049_1; P_W00948; S72864; P_W00949; 162742; AF038501_1; TKNG_HUMAN; and YAT1_RHOBL. Based on the information provided herein, PRO1155 may play a role in providing neuroprotection and cognitive enhancement.

Example 113

Isolation of cDNA Clones Encoding Human PRO1156

Use of the signal sequence algorithm described in Example 3 above allowed identification of a single EST cluster sequence from the Incyte database, designated herein as 138851. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56261.

In light of an observed sequence homology between the DNA56261 consensus sequence and an EST sequence encompassed within the Incyte EST clone no. 3675191, the Incyte EST clone 3675191 was purchased and the cDNA insert was obtained and sequenced. It was found that this insert encoded a full-length protein. The sequence of this cDNA insert is shown in FIG. 255 and is herein designated as DNA59853-1505.

The full length clone shown in FIG. 255 contained a single open reading frame with an apparent translational initiation site at nucleotide positions 212–214 and ending at the stop codon found at nucleotide positions 689–691 (FIG. 255; SEQ ID NO:360). The predicted polypeptide precursor (FIG. 256, SEQ ID NO:361) is 159 amino acids long. PRO1156 has a calculated molecular weight of approximately 17,476 daltons, an estimated pI of approximately 9.15, a signal peptide sequence at about amino acids 1 to about 22, and potential N-glycosylation sites at about amino acids 27–30 and 41–44.

Clone DNA59853-1505 was deposited with the ATCC on Jun. 16, 1998 and is assigned ATCC deposit no. 209985.

An analysis of the Dayhoff database (version 35.45 SwissProt 35), using a WU-BLAST2 sequence alignment analysis (using the ALIGN computer program) of the full-length sequence shown in FIG. 256 (SEQ ID NO:361), revealed some homology between the PRO1156 amino acid sequence and the following Dayhoff sequences: D45027_1, P_R79914, JC5309, KBF2_HUMAN, AF010144_1, GEN14351, S68681, P_R79915, ZMTAC_3, and HUMCPGO_1.

Example 114

Isolation of cDNA Clones Encoding Human PRO1098

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56377.

In light of an observed sequence homology between the DNA56377 consensus sequence and an EST sequence encompassed within the Incyte EST clone no. 3050917, the Incyte EST clone 3050917 was purchased and the cDNA insert was obtained and sequenced. It was found that this insert encoded a full-length protein. The sequence of this cDNA insert is shown in FIG. 257 and is herein designated as DNA59854-1459.

The entire nucleotide sequence of DNA59854-1459 is shown in FIG. 257 (SEQ ID NO:362). Clone DNA59854-1459 contains a single open reading frame with an apparent translational initiation site at nucleotide positions 58–60 and ending at the stop codon at nucleotide positions 292–294 of SEQ ID NO:362 (FIG. 257). The predicted polypeptide precursor is 78 amino acids long (FIG. 258). The full-length PRO1098 protein shown in FIG. 258 has an estimated molecular weight of about 8,396 daltons and a pI of about 7.66. Clone DNA59854-1459 has been deposited with ATCC on Jun. 16, 1998. It is understood that the deposited clone has the actual nucleic acid sequence and that the sequences provided herein are based on known sequencing techniques.

Analyzing FIG. 258, a signal peptide appears to be at about amino acids 1–19 of SEQ ID NO:363, an N-glycosylation site appears to be at about amino acids 37–40 of SEQ ID NO:363, and N-myristoylation sites appear to be at about 15–20, 19–24 and 60–65 of SEQ ID NO:363.

Example 115

Isolation of cDNA Clones Encoding Human PRO1127

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57959.

In light of an observed sequence homology between the DNA57959 consensus sequence and an EST sequence encompassed within the Merck EST clone no. 685126, the Merck EST clone 685126 was purchased and the cDNA insert was obtained and sequenced. It was found that this insert encoded a full-length protein. The sequence of this cDNA insert is shown in FIG. 259 and is herein designated as DNA60283-1484.

The full length clone shown in FIG. 259 contained a single open reading frame with an apparent translational initiation site at nucleotide positions 126–128 and ending at the stop codon found at nucleotide positions 327–329 (FIG. 259; SEQ ID NO:364). The predicted polypeptide precursor (FIG. 260, SEQ ID NO:365) is 67 amino acids long including a signal peptide at about 1–29 of SEQ ID NO:365. PRO1127 has a calculated molecular weight of approximately 7,528 daltons and an estimated pI of approximately 4.95. Clone DNA60283-1484 was deposited with the ATCC on Jul. 1, 1998 and is assigned ATCC deposit no. 203043. It is understood that the deposited clone has the actual sequence, whereas representations which may have minor sequencing errors are presented herein.

An analysis of the Dayhoff database (version 35.45 SwissProt 35), using a WU-BLAST2 sequence alignment analysis of the full-length sequence shown in FIG. 260 (SEQ ID NO:365), revealed some homology between the PRO1127 amino acid sequence and the following Dayhoff sequences: AF037218_48, P_W09638, HBA_HETPO, S39821, KR2_EBV, CET2OD3_8, HCU37630_1, HS193B12_10, S40012 and TRITUBC_1.

Example 116

Isolation of cDNA Clones Encoding Human PRO1126

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56250.

In light of an observed sequence homology between the DNA56250 consensus sequence and an EST sequence encompassed within the Incyte EST clone no. 1437250, the Incyte EST clone 1437250 was purchased and the cDNA insert was obtained and sequenced. It was found that this insert encoded a full-length protein. The sequence of this cDNA insert is shown in FIG. 261 and is herein designated as DNA60615-1483.

Clone DNA60615-1483 contains a single open reading frame with an apparent translational initiation site at nucleotide positions 110–112 and ending at the stop codon at nucleotide positions 1316–1318 (FIG. 261). The predicted polypeptide precursor is 402 amino acids long (FIG. 262). The full-length PRO1126 protein shown in FIG. 262 has an estimated molecular weight of about 45,921 daltons and a pI of about 8.60. Analysis of the full-length PRO1126 sequence shown in FIG. 262 (SEQ ID NO:367) evidences the presence of the following: a signal peptide from about amino acid 1 to about amino acid 25 and potential N-glycosylation sites from about amino acid 66 to about amino acid 69, from about amino acid 138 to about amino acid 141 and from about amino acid 183 to about amino acid 186. Clone DNA60615-1483 has been deposited with ATCC on Jun. 16, 1998 and is assigned ATCC deposit no. 209980.

An analysis of the Dayhoff database (version 35.45 SwissProt 35), using a WU-BLAST2 sequence alignment analysis of the full-length sequence shown in FIG. 262 (SEQ ID NO:367), evidenced significant homology between the PRO1126 amino acid sequence and the following Dayhoff sequences: I73636, NOMR_HUMAN, MMUSMYOC3_1, HS454G6_1, P_R98225, RNU78105_1, RNU72487_1, AF035301_1, CEELC48E7_4 and CEF11C3_3.

Example 117

Isolation of cDNA Clones Encoding Human PRO1125

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56540.

In light of an observed sequence homology between the DNA56540 consensus sequence and an EST sequence encompassed within the Incyte EST clone no. 1486114, the Incyte EST clone 1486114 was purchased and the cDNA insert was obtained and sequenced. It was found that this insert encoded a full-length protein. The sequence of this cDNA insert is shown in FIG. 263 and is herein designated as DNA60615-1483.

The full length clone shown in FIG. 263 contained a single open reading frame with an apparent translational initiation site at nucleotide positions 4749 and ending at the stop codon found at nucleotide positions 1388–1390 (FIG. 263; SEQ ID NO:368). The predicted polypeptide precursor (FIG. 264, SEQ ID NO:369) is 447 amino acids long. PRO1125 has a calculated molecular weight of approximately 49,798 daltons and an estimated pI of approximately 9.78. Clone DNA60619-1482 has been deposited with ATCC and is assigned ATCC deposit no. 209993. It is understood that the clone has the actual sequence and that the sequences herein are representations based on current techniques which may be prone to minor errors.

Based on a WU-BLAST2 sequence alignment analysis (using the ALIGN computer program) of the full-length sequence, PRO1125 shows some sequence identity with the following Dayhoff designations: RCO1_NEUCR; S58306; PKWA_THECU; S76086; P_R85881; HET1_PODAN; SPU92792_1; APAF_HUMAN; S76414 and S59317.

Example 118

Isolation of cDNA Clones Encoding Human PRO1186

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56748.

In light of an observed sequence homology between the DNA56748 consensus sequence and an EST sequence encompassed within the Incyte EST clone no. 3476792, the Incyte EST clone 3476792 was purchased and the cDNA insert was obtained and sequenced. It was found that this insert encoded a full-length protein. The sequence of this cDNA insert is shown in FIG. 265 and is herein designated as DNA60621-1516.

The full length clone shown in FIG. 265 contained a single open reading frame with an apparent translational initiation site at nucleotide positions 91–93 and ending at the stop codon found at nucleotide positions 406–408 (FIG. 265; SEQ ID NO:370). The predicted polypeptide precursor (FIG. 266, SEQ ID NO:371) is 105 amino acids long. The signal peptide is at amino acids 1–19 of SEQ ID NO:371. PRO1186 has a calculated molecular weight of approximately 11,715 daltons and an estimated pI of approximately 9.05. Clone DNA60621-1516 was deposited with the ATCC on Aug. 4, 1998 and is assigned ATCC deposit no. 203091.

An analysis of the Dayhoff database (version 35.45 SwissProt 35), using a WU-BLAST2 sequence alignment analysis of the full-length sequence shown in FIG. 266 (SEQ ID NO:371), revealed some sequence identity between the PRO1186 amino acid sequence and the following Dayhoff sequences: VPRA_DENPO, LFE4_CHICK, AF034208_1, AF030433_1, A55035, COL_RABIT, CELB0507_9, S67826_1, S34665 and CRU73817_1.

Example 119

Isolation of cDNA Clones Encoding Human PRO1198

An initial DNA sequence referred to herein as DNA52083 was identified using a yeast screen in a human umbilical vein endothelial cell cDNA library that preferentially represents the 5' ends of the primary cDNA clones. DNA52083 was compared to ESTs from public databases (e.g., GenBank), and a proprietary EST database (LIFESEQ®, Incyte Pharmaceuticals, Palo Alto, Calif.), using the computer program BLAST or BLAST2 [Altshul et al., Methods in Enzymology, 266:460–480 (1996)]. The ESTs were clustered and assembled into a consensus DNA sequence using the computer program "phrap" (Phil Green, University of Washington, Seattle, Wash.). One or more of the ESTs was obtained from human breast skin tissue biopsy. This consensus sequence is designated herein as DNA52780.

In light of an observed sequence homology between the DNA52780 consensus sequence and an EST sequence encompassed within the Incyte EST clone no. 3852910, the Incyte EST clone 3852910 was purchased and the cDNA insert was obtained and sequenced. It was found that this insert encoded a full-length protein. The sequence of this cDNA insert is shown in FIG. 267 and is herein designated as DNA60622-1525.

The full length DNA60622-1525 clone shown in FIG. 267 (SEQ ID NO:372) contained a single open reading frame with an apparent translational initiation site at nucleotide positions 54 to 56 and ending at the stop codon found at nucleotide positions 741 to 743. The predicted polypeptide precursor, which is shown in FIG. 268 (SEQ ID NO:373), is 229 amino acids long. PRO1198 has a calculated molecular weight of approximately 25,764 daltons and an estimated pI of approximately 9.17. There is a signal peptide sequence at about amino acids 1 through 34. There is sequence identity with glycosyl hydrolases family 31 protein at about amino acids 142 to about 175.

An analysis of the Dayhoff database (version 35.45 SwissProt 35), using a WU-BLAST2 sequence alignment analysis of the full-length sequence shown in FIG. 268 (SEQ ID NO:373), revealed some homology between the PRO1198 amino acid sequence and the following Dayhoff sequences: ATF6H11_6, UCRI_RAT, TOBSUP2NT_1, RCUERF3_1, AMU88186_1, P_W22485, S56579, AF040711_1, DPP4_PIG.

Clone DNA60622-1525 was been deposited with the ATCC on Aug. 4, 1998, and is assigned ATCC deposit no. 203090.

Example 120

Isolation of cDNA Clones Encoding Human PRO1158

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57248.

In light of an observed sequence homology between the DNA57248 consensus sequence and an EST sequence encompassed within the Incyte EST clone no. 2640776, the Incyte EST clone 2640776 was purchased and the cDNA insert was obtained and sequenced. It was found that this insert encoded a full-length protein. The sequence of this cDNA insert is shown in FIG. 269 and is herein designated as DNA60625-1507.

The full length clone shown in FIG. 269 contained a single open reading frame with an apparent translational initiation site at nucleotide positions 163 to 165 and ending at the stop codon found at nucleotide positions 532 to 534 (FIG. 269; SEQ ID NO:374). The predicted polypeptide precursor (FIG. 270, SEQ ID NO:375) is 123 amino acids long. PRO1158 has a calculated molecular weight of approximately 13,113 daltons and an estimated pI of approximately 8.53. Additional features include a signal peptide sequence at about amino acids 1–19, a transmembrane domain at about amino acids 56–80, and a potential N-glycosylation site at about amino acids 36–39. Clone DNA60625-1507 was deposited with the ATCC on Jun. 16, 1998 and is assigned ATCC deposit no. 209975.

An analysis of the Dayhoff database (version 35.45 SwissProt 35), using a WU-BLAST2 sequence alignment analysis of the full-length sequence shown in FIG. 270 (SEQ ID NO:375), revealed some homology between the PRO1158 amino acid sequence and the following Dayhoff sequences: ATAC00310510F18A8.10, P_R85151, PHS2_SOLTU, RNMHCIBAC_1, RNALFMHC_1, I68771, RNRT1A10G_1, PTPA_HUMAN, HUMGACA_1, and CHKPTPA_1.

Example 121

Isolation of cDNA Clones Encoding Human PRO1159

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57221.

In light of an observed sequence homology between the DNA57221 consensus sequence and an EST sequence encompassed within the Incyte EST clone no. 376776, the Incyte EST clone 376776 was purchased and the cDNA insert was obtained and sequenced. It was found that this insert encoded a full-length protein. The sequence of this cDNA insert is shown in FIG. 271 and is herein designated as DNA60627-1508.

Clone DNA60627-1508 contains a single open reading frame with an apparent translational initiation site at nucleotide positions 92–94 and ending at the stop codon at nucleotide positions 362–364 (FIG. 271). The predicted polypeptide precursor is 90 amino acids long (FIG. 272). The full-length PRO1159 protein shown in FIG. 272 has an estimated molecular weight of about 9,840 daltons and a pI of about 10.13. Analysis of the full-length PRO1159 sequence shown in FIG. 272 (SEQ ID NO:377) evidences the presence of the following: a signal peptide from about amino acid 1 to about amino acid 15 and a potential N-glycosylation site from about amino acid 38 to about amino acid 41. Clone DNA60627-1508 has been deposited with ATCC on Aug. 4, 1998 and is assigned ATCC deposit no. 203092.

An analysis of the Dayhoff database (version 35.45 SwissProt 35), using a WU-BLAST2 sequence alignment analysis of the full-length sequence shown in FIG. 272 (SEQ ID NO:377), evidenced significant homology between the PRO1159 amino acid sequence and the following Dayhoff sequences: AF016494_6, AF036708_20, DSSCUTE_1, D89100_1, S28060, MEFA_XENLA, AF020798_12, G70065, E64423, JQ2005.

Example 122

Isolation of cDNA Clones Encoding Human PRO1124

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56035.

In light of an observed sequence homology between the DNA56035 consensus sequence and an EST sequence encompassed within the Incyte EST clone no. 2767646, the Incyte EST clone 2767646 was purchased and the cDNA insert was obtained and sequenced. It was found that this insert encoded a full-length protein. The sequence of this cDNA insert is shown in FIG. 273 and is herein designated as DNA60629-1481.

The full length clone shown in FIG. 273 contained a single open reading frame with an apparent translational initiation site at nucleotide positions 25–27 and ending at the stop codon found at nucleotide positions 2782–2784 (FIG. 273; SEQ ID NO:378). The predicted polypeptide precursor (FIG. 274, SEQ ID NO:379) is 919 amino acids long. PRO1124 has a calculated molecular weight of approximately 101,282 daltons and an estimated pI of approximately 5.37. Clone DNA60629-1481 has been deposited with the ATCC and is assigned ATCC deposit no. 209979. It is understood that the deposited clone has the actual sequence, whereas only representations based on current sequencing techniques which may include normal and minor errors, are provided herein.

Based on a WU-BLAST2 sequence alignment analysis of the full-length sequence, PRO1124 shows significant amino acid sequence identity to a chloride channel protein and to ECAM-1. Specifically, the following Dayhoff designations were identified as having sequence identity with PRO1124: ECLC_BOVIN, AF001261_1, P_W06548, SSC6A10_1, AF004355_1, S76691, AF017642, BYU06866_2, CSA_DICDI and SAU47139_2.

Example 123

Isolation of cDNA Clones Encoding Human PRO1287

An expressed sequence tag (EST) DNA database (LIFESEQ®, Incyte Pharmaceuticals, Palo Alto, Calif.) was searched and an EST was identified which showed homology to the fringe protein. This EST sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., Methods in Enzymology, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence obtained is herein designated DNA40568.

Based on the DNA40568 consensus sequence, oligonucleotides were synthesized: 1) to identify by PCR a cDNA library that contained the sequence of interest, and 2) for use as probes to isolate a clone of the full-length coding sequence for PRO1287. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., Current Protocols in Molecular Biology, supra, with the PCR primer pair. A positive library was then used to isolate clones encoding the gene of interest using the probe oligonucleotide and one of the primer pairs.

PCR primers (forward and reverse) were synthesized:

```
forward PCR primer    5'-CTCGGGGAAAGGGACTTGATGTTGG-3'   (SEQ ID NO:382)
reverse PCR primer 1  5'-GCGAAGGTGAGCCTCTATCTCGTGCC-3'  (SEQ ID NO:383)
reverse PCR primer 2  5'-CAGCCTACACGTATTGAGG-3'          (SEQ ID NO:384)
```

Additionally, a synthetic oligonucleotide hybridization probe was constructed from the consensus DNA40568 sequence which had the following nucleotide sequence
Hybridization Probe
5'-CAGTCAGTACAATCCTGGCATAATATACGGCCA
CCATGATGCAGTCCC-3' (SEQ ID NO:385).

In order to screen several libraries for a source of a full-length clone, DNA from the libraries was screened by PCR amplification with the PCR primer pairs identified above. A positive library was then used to isolate clones encoding the PRO1287 gene using the probe oligonucleotide and one of the PCR primers.

RNA for construction of the cDNA libraries was isolated from human bone marrow tissue. The cDNA libraries used to isolated the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or PRKD; pRK5B is a precursor of pRK5D that does not contain the SfiI site; see, Holmes et al., Science, 253:1278–1280 (1991)) in the unique XhoI and NotI sites.

DNA sequencing of the clones isolated as described above gave the full-length DNA sequence for PRO1287 (designated herein as DNA61755-1554 [FIG. 275, SEQ ID NO:380]) and the derived protein sequence for PRO1287.

The entire nucleotide sequence of DNA61755-1554 is shown in FIG. 275 (SEQ ID NO:380). The full length clone contained a single open reading frame with an apparent translational initiation site at nucleotide positions 655–657 and a stop signal at nucleotide positions 2251–2253 (FIG. 275, SEQ ID NO:380). The predicted polypeptide precursor is 532 amino acids long, has a calculated molecular weight of approximately 61,351 daltons and an estimated pI of approximately 8.77. Analysis of the full-length PRO1287 sequence shown in FIG. 276 (SEQ ID NO:381) evidences the presence of the following: a signal peptide from about amino acid 1 to about amino acid 27 and potential N-glycosylation sites from about amino acid 315 to about amino acid 318 and from about amino acid 324 to about amino acid 327. Clone DNA61755-1554 has been deposited with ATCC on Aug. 11, 1998 and is assigned ATCC deposit no. 203112.

An analysis of the Dayhoff database (version 35.45 SwissProt 35), using a WU-BLAST2 sequence alignment analysis of the full-length sequence shown in FIG. 276 (SEQ ID NO:381), evidenced significant homology between the PRO1287 amino acid sequence and the following Dayhoff sequences: CET24D1__1, EZRI__BOVIN, GGU19889__1, CC3__YEAST, S74244, NALS__MOUSE, MOES__PIG, S28660, S44860 and YNA4__CAEEL.

Example 124

Isolation of cDNA Clones Encoding Human PRO1312

DNA55773 was identified in a human fetal kidney cDNA library using a yeast screen that preferentially represents the 5' ends of the primary cDNA clones. Based on the DNA55773 sequence, oligonucleotides were synthesized for use as probes to isolate a clone of the full-length coding sequence for PRO1312.

The full length DNA61873-1574 clone shown in FIG. 277 (SEQ ID NO:386) contained a single open reading frame with an apparent translational initiation site at nucleotide positions 7–9 and ending at the stop codon found at nucleotide positions 643–645. The predicted polypeptide precursor is 212 amino acids long (FIG. 278, SEQ ID NO:387). PRO1312 has a calculated molecular weight of approximately 24,024 daltons and an estimated pI of approximately 6.26. Other features include a signal peptide at about amino acids 1–14; a transmembrane domain at about amino acids 141–160, and potential N-glycosylation sites at about amino acids 76–79 and 93–96.

An analysis of the Dayhoff database (version 35.45 SwissProt 35), using a WU-BLAST2 sequence alignment analysis of the full-length sequence shown in FIG. 278 (SEQ ID NO:387), revealed some homology between the PRO1312 amino acid sequence and the following Dayhoff sequences: GCINTALPH__1, GIBMUC1A__1, P__R96298, AF001406__1, PVU88874__1, P__R85151, AF041409__1, CELC50F2__7, C45875, and AB009510__21.

Clone DNA61873-1574 has been deposited with ATCC and is assigned ATCC deposit no. 203132.

Example 125

Isolation of cDNA Clones Encoding Human PRO1192

A consensus DNA sequence was assembled relative to other EST sequences using phrap as described in Example 1 above. This consensus sequence is designated herein DNA35924. Based on the DNA35924 consensus sequence, oligonucleotides were synthesized: 1) to identify by PCR a cDNA library that contained the sequence of interest, and 2) for use as probes to isolate a clone of the full-length coding sequence for PRO1192.

PCR primers (forward and reverse) were synthesized:

Additionally, a synthetic oligonucleotide hybridization probe was constructed from the consensus DNA35924 sequence which had the following nucleotide sequence:

Hybridization Probe:
5'-GAGAGGACTGCGGGAGTTTGGGACCTTTGTGC
   AGACGTGCTCATG-3' (SEQ ID NO:392).

In order to screen several libraries for a source of a full-length clone, DNA from the libraries was screened by PCR amplification with the PCR primer pair identified above. A positive library was then used to isolate clones encoding the PRO1192 gene using the probe oligonucleotide and one of the PCR primers. RNA for construction of the cDNA libraries was isolated from human fetal liver and spleen tissue.

DNA sequencing of the clones isolated as described above gave the full-length DNA sequence for PRO1192 designated herein as DNA62814-1521 and shown in FIG. 279 (SEQ ID NO:388); and the derived protein sequence for PRO1192 which is shown in FIG. 280 (SEQ ID NO:389).

The entire coding sequence of PRO1192 is shown in FIG. 279 (SEQ ID NO:388). Clone DNA62814-1521 contains a single open reading frame with an apparent translational initiation site at nucleotide positions 121–123 and an apparent stop codon at nucleotide positions 766–768. The predicted polypeptide precursor is 215 amino acids long. The predicted polypeptide precursor has the following features: a signal peptide at about amino acids 1–21; a transmembrane domain at about amino acids 153–176; potential N-glycosylation sites at about amino acids 39–42 and 118–121; and homology with myelin P0 proteins at about amino acids 27–68 and 99–128 of FIG. 280. The full-length PRO1192 protein shown in FIG. 280 has an estimated molecular weight of about 24,484 daltons and a pI of about 6.98.

An analysis of the Dayhoff database (version 35.45 SwissProt 35), using a WU-BLAST2 sequence alignment analysis of the full-length sequence shown in FIG. 280 (SEQ ID NO:389), revealed homology between the PRO1192 amino acid sequence and the following Dayhoff sequences: GEN12838, MYP0__HUMAN, AF049498__1, GEN14531, P__W14146, HS46KDA__1, CINB__RAT, OX2G__RAT, D87018__1, and D86996__2.

Clone DNA62814-1521 was deposited with the ATCC on Aug. 4, 1998, and is assigned ATCC deposit no. 203093.

Example 126

Isolation of cDNA Clones Encoding Human PRO1160

A consensus DNA sequence was assembled relative to other EST sequences using phrap as described in Example 1 above. This consensus sequence is herein designated DNA40650. Based on the DNA40650 consensus sequence, oligonucleotides were synthesized: 1) to identify by PCR a cDNA library that contained the sequence of interest, and 2) for use as probes to isolate a clone of the full-length coding sequence for PRO1160.

PCR primers (forward and reverse) were synthesized:

```
forward PCR primer: 5'-CCGAGGCCATCTAGAGGCCAGAGC-3'  (SEQ ID NO:390)
reverse PCR primer: 5'-ACAGGCAGAGCCAATGGCCAGAGC-3'  (SEQ ID NO:391).
``` forward PCR primer 5'-GCTCCCTGATCTTCATGTCACCACC-3' (SEQ ID NO:395)

reverse PCR primer 5'-CAGGGACACACTCTACCATTCGGGAG-3' (SEQ ID NO:396)

Additionally, a synthetic oligonucleotide hybridization probe was constructed from the consensus DNA40650 sequence which had the following nucleotide sequence Hybridization Probe
5'-CCATCTTTCTGGTCTCTGCCCAGAATCCGACAA CAGCTGCTC-3' (SEQ ID NO:397)

In order to screen several libraries for a source of a full-length clone, DNA from the libraries was screened by PCR amplification with the PCR primer pair identified above. A positive library was then used to isolate clones encoding the PRO1160 gene using the probe oligonucleotide and one of the PCR primers. RNA for construction of the cDNA libraries was isolated from human breast tissue.

DNA sequencing of the clones isolated as described above gave the full-length DNA sequence for PRO1160 (designated herein as DNA62872-1509 [FIG. 281, SEQ ID NO:393]) and the derived protein sequence for PRO1160.

The entire nucleotide sequence of DNA62872-1509 is shown in FIG. 281 (SEQ ID NO:393). Clone DNA62872-1509 contains a single open reading frame with an apparent translational initiation site at nucleotide positions 40–42 and ending at the stop codon at nucleotide positions 310–312 (FIG. 281). The predicted polypeptide precursor is 90 amino acids long (FIG. 282). The full-length PRO1160 protein shown in FIG. 282 has an estimated molecular weight of about 9,039 daltons and a pI of about 4.37. Analysis of the full-length PRO1160 sequence shown in FIG. 282 (SEQ ID NO:394) evidences the presence of the following: a signal peptide from about amino acid 1 to about amino acid 19 and a protein kinase C phosphorylation site from about amino acid 68 to about amino acid 70. Clone DNA62872-1509 has been deposited with ATCC on Aug. 4, 1998 and is assigned ATCC deposit no. 203100.

An analysis of the Dayhoff database (version 35.45 SwissProt 35), using a WU-BLAST2 sequence alignment analysis of the full-length sequence shown in FIG. 282 (SEQ ID NO:394), evidenced significant homology between the PRO1160 amino acid sequence and the following Dayhoff sequences: B30305, GEN13490, I53641, S53363, HA34_BRELC, SP96_DICDI, S36326, SSU51197_10, MUC1_XENLA, TCU32448_1 and AF000409_1.

Example 127

Isolation of cDNA Clones Encoding Human PRO1187

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57726.

In light of an observed sequence homology between the DNA57726 consensus sequence and an EST sequence encompassed within the Incyte EST clone no. 358563, the Incyte EST clone 358563 was purchased and the cDNA insert was obtained and sequenced. It was found that this insert encoded a full-length protein. The sequence of this cDNA insert is shown in FIG. 283 and is herein designated as DNA62876-1517.

The full length clone shown in FIG. 283 contained a single open reading frame with an apparent translational initiation site at nucleotide positions 121–123 and ending at the stop codon found at nucleotide positions 481–483 (FIG. 283; SEQ ID NO:398). The predicted polypeptide precursor (FIG. 284, SEQ ID NO:399) is 120 amino acids long. The signal peptide is at about amino acids 1–17 of SEQ ID NO:399. PRO1187 has a calculated molecular weight of approximately 12,925 daltons and an estimated pI of approximately 9.46. Clone DNA62876-1517 was deposited with the ATCC on Aug. 4, 1998 and is assigned ATCC deposit no. 203095. It is understood that the deposited clone contains the actual sequence and that the representations herein may have minor sequencing errors. An analysis of the Dayhoff database (version 35.45 SwissProt 35), using a WU-BLAST2 sequence alignment analysis of the full-length sequence shown in FIG. 284 (SEQ ID NO:399), revealed some sequence identity (and therefore some relation) between the PRO1187 amino acid sequence and the following Dayhoff sequences: MGNENDOBX_1, CELF41G3_9, AMPG_STRLI, HSBBOVHERL_2, LEEXTEN10_1, AF0299581 and P_W04957.

Example 128

Isolation of cDNA Clones Encoding Human PRO1185

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56426.

In light of an observed sequence homology between the DNA56426 consensus sequence and an EST sequence encompassed within the Incyte EST clone no. 3284411, the Incyte EST clone 3284411 was purchased and the cDNA insert was obtained and sequenced. It was found that this insert encoded a full-length protein. The sequence of this cDNA insert is shown in FIG. 285 and is herein designated as DNA62881-1515.

The full length DNA62881-1515 clone shown in FIG. 285 contained a single open reading frame with an apparent translational initiation site at nucleotide positions 4–6 and ending at the stop codon found at nucleotide positions 598–600 (FIG. 285; SEQ ID NO:400). The predicted polypeptide precursor (FIG. 286, SEQ ID NO:401) is 198 amino acids long. The signal peptide is at about amino acids 1–21 of SEQ ID NO:401. PRO1185 has a calculated molecular weight of approximately 22,105 daltons and an estimated pI of approximately 7.73. Clone DNA62881-1515 has been deposited with the ATCC and is assigned ATCC deposit no. 203096.

An analysis of the Dayhoff database (version 35.45 SwissProt 35), using a WU-BLAST2 sequence alignment analysis of the full-length sequence shown in FIG. 286 (SEQ ID NO:401), revealed some sequence identity between the PRO1185 amino acid sequence and the following Dayhoff sequences: TUP1_YEAST, AF041382_1, MAOM_SOLTU, SPPBPHU9_1, I41024, EPCPLCFAIL_1, HSPLEC_1, YKLA_CAEEL, A44643, TGU65922_1.

Example 129

Isolation of cDNA Clones Encoding Human PRO1345

A consensus DNA sequence was assembled relative to other EST sequences using phrap as described in Example 1 above. This consensus sequence is herein designated DNA47364. Based on the DNA47364 consensus sequence, oligonucleotides were synthesized: 1) to identify by PCR a cDNA library that contained the sequence of interest, and 2) for use as probes to isolate a clone of the full-length coding sequence for PRO1345.

PCR primers (forward and reverse) were synthesized:

```
forward PCR primer 5'-CCTGGTTATCCCCAGGAACTCCGAC-3' (SEQ ID NO:404)
reverse PCR primer 5'-CTCTTGCTGCTGCGACAGGCCTC-3'   (SEQ ID NO:405)
```

Additionally, a synthetic oligonucleotide hybridization probe was constructed from the consensus DNA47364 sequence which had the following nucleotide sequence Hybridization Probe
5'-CGCCCTCCAAGACTATGGTAAAAGGAGCCTGC CAGGTGTCAATGAC-3' (SEQ ID NO:406)

In order to screen several libraries for a source of a full-length clone, DNA from the libraries was screened by PCR amplification with the PCR primer pair identified above. A positive library was then used to isolate clones encoding the PRO1345 gene using the probe oligonucleotide and one of the PCR primers. RNA for construction of the cDNA libraries was isolated from human breast carcinoma tissue.

DNA sequencing of the clones isolated as described above gave the full-length DNA sequence for PRO1345 (designated herein as DNA64852-1589 [FIG. 287, SEQ ID NO:402]) and the derived protein sequence for PRO1345.

The entire nucleotide sequence of DNA64852-1589 is shown in FIG. 287 (SEQ ID NO:402). Clone DNA64852-1589 contains a single open reading frame with an apparent translational initiation site at nucleotide positions 7–9 or 34–36 and ending at the stop codon at nucleotide positions 625–627 (FIG. 287). The predicted polypeptide precursor is 206 amino acids long (FIG. 288). The full-length PRO1345 protein shown in FIG. 288 has an estimated molecular weight of about 23,190 daltons and a pI of about 9.40. Analysis of the full-length PRO1345 sequence shown in FIG. 288 (SEQ ID NO:403) evidences the presence of the following: a signal peptide from about amino acid 1 to about amino acid 31 or from about amino acid 10 to about amino acid 31 and a C-type lectin domain signature sequence from about amino acid 176 to about amino acid 190. Clone DNA64852-1589 has been deposited with ATCC on Aug. 18, 1998 and is assigned ATCC deposit no. 203127.

An analysis of the Dayhoff database (version 35.45 SwissProt 35), using a WU-BLAST2 sequence alignment analysis of the full-length sequence shown in FIG. 288 (SEQ ID NO:403), evidenced significant homology between the PRO1345 amino acid sequence and the following Dayhoff sequences: BTU22298_1, TETN_CARSP, TETN_HUMAN, MABA_RAT, S34198, P_W13144, MACMBPA_1, A46274, PSPD_RAT AND P_R32188.

Example 130

Isolation of cDNA Clones Encoding Human PRO1245

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56019.

In light of an observed sequence homology between the DNA56019 consensus sequence and an EST sequence encompassed within the Incyte EST clone no. 1327836, the Incyte EST clone 1327836 was purchased and the cDNA insert was obtained and sequenced. It was found that this insert encoded a full-length protein. The sequence of this cDNA insert is shown in FIG. 289 and is herein designated as DNA64884-1527.

The full length clone shown in FIG. 289 contained a single open reading frame with an apparent translational initiation site at nucleotide positions 79–81 and ending at the stop codon found at nucleotide positions 391–393 (FIG. 289; SEQ ID NO:407). The predicted polypeptide precursor (FIG. 290, SEQ ID NO:408) is 104 amino acids long, with a signal peptide sequence at about amino acid 1 to about amino acid 18. PRO1245 has a calculated molecular weight of approximately 10,100 daltons and an estimated pI of approximately 8.76.

An analysis of the Dayhoff database (version 35.45 SwissProt 35), using a WU-BLAST2 sequence alignment analysis of the full-length sequence shown in FIG. 290 (SEQ ID NO:408), revealed some homology between the PRO1245 amino acid sequence and the following Dayhoff sequences: SYA_THETH, GEN11167, MTV044_4, AB011151_1, RLAJ2750_3, SNELIPTRA_1, S63624, C28391, A37907, and S14064.

Clone DNA64884-1245 was deposited with the ATCC on Aug. 25, 1998 and is assigned ATCC deposit no. 203155.

Example 131

Isolation of cDNA Clones Encoding Human PRO1358

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.).

In light of an observed sequence homology between the consensus sequence and an EST sequence encompassed within the Incyte EST clone no. 88718, the Incyte EST clone 88718 was purchased and the cDNA insert was obtained and sequenced. It was found that this insert encoded a full-length protein. The sequence of this cDNA insert is shown in FIG. 291 and is herein designated as DNA64890-1612.

The full length clone shown in FIG. 291 contained a single open reading frame with an apparent translational initiation site at nucleotide positions 86 through 88 and ending at the stop codon found at nucleotide positions 1418 through 1420 (FIG. 291; SEQ ID NO:409). The predicted polypeptide precursor (FIG. 292, SEQ ID NO:410) is 444 amino acids long. The signal peptide is at about amino acids 1–18 of SEQ ID NO:410. PRO1358 has a calculated molecular weight of approximately 50,719 daltons and an estimated pI of approximately 8.82. Clone DNA64890-1612 was deposited with the ATCC on Aug. 18, 1998 and is assigned ATCC deposit no. 203131.

An analysis of the Dayhoff database (version 35.45 SwissProt 35), using a WU-BLAST2 sequence alignment analysis of the full-length sequence shown in FIG. 292 (SEQ ID NO:410), revealed sequence identity between the PRO1358 amino acid sequence and the following Dayhoff sequences: P_W07607, AB000545_1, AB000546_1, ALAT_RAT, AB015164_1, P_P50021, COTR_CAVPO, and HAMHPP_1. The variants claimed in this application exclude these sequences.

Example 132

Isolation of cDNA Clones Encoding Human PRO1195

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55716.

In light of an observed sequence homology between the DNA55716 consensus sequence and an EST sequence encompassed within the Incyte EST clone no. 3252980, the Incyte EST clone 3252980 was purchased and the cDNA insert was obtained and sequenced. It was found that this insert encoded a full-length protein. The sequence of this cDNA insert is shown in FIG. 293 and is herein designated as DNA65412-1523.

The full length clone shown in FIG. 293 contained a single open reading frame with an apparent translational initiation site at nucleotide positions 58–60 and ending at the stop codon found at nucleotide positions 511–513 (FIG. 293; SEQ ID NO:411). The predicted polypeptide precursor (FIG. 294, SEQ ID NO:412) is 151 amino acids long. The signal sequence is at about amino acids 1–22 of SEQ ID NO:412. PRO1195 has a calculated molecular weight of approximately 17,277 daltons and an estimated pI of approximately 5.33. Clone DNA65412-1523 was deposited with the ATCC on Aug. 4, 1998 and is assigned ATCC deposit no. 203094.

An analysis of the Dayhoff database (version 35.45 SwissProt 35), using a WU-BLAST2 sequence alignment analysis of the full-length sequence shown in FIG. 294 (SEQ ID NO:412), revealed some sequence identity between the PRO1195 amino acid sequence and the following Dayhoff sequences: MMU28486_1, AF0442051, P_W31186, CELK03C7_1, F69034, EFIA_METVA, AF024540_1, SSU90353_1, MRSP_STAAU and P_R97680.

Example 133

Isolation of cDNA Clones Encoding Human PRO1270

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57951.

In light of an observed sequence homology between the DNA57951 consensus sequence and an EST sequence encompassed within the Merck EST clone no. 124878, the Merck EST clone 124878 was purchased and the cDNA insert was obtained and sequenced. It was found that this insert encoded a full-length protein. The sequence of this cDNA insert is shown in FIG. 295 and is herein designated as DNA66308-1537.

Clone DNA66308-1537 contains a single open reading frame with an apparent translational initiation site at nucleotide positions 103–105 and ending at the stop codon at nucleotide positions 1042–1044 (FIG. 295). The predicted polypeptide precursor is 313 amino acids long (FIG. 296). The full-length PRO1270 protein shown in FIG. 296 has an estimated molecular weight of about 34,978 daltons and a pI of about 5.71. Analysis of the full-length PRO1270 sequence shown in FIG. 296 (SEQ ID NO:414) evidences the presence of the following: a signal peptide from about amino acid 1 to about amino acid 16, a potential N-glycosylation site from about amino acid 163 to about amino acid 166 and glycosaminoglycan attachment sites from about amino acid 74 to about amino acid 77 and from about amino acid 289 to about amino acid 292. Clone DNA66308-1537 has been deposited with ATCC on Aug. 25, 1998 and is assigned ATCC deposit no. 203159.

An analysis of the Dayhoff database (version 35.45 SwissProt 35), using a WU-BLAST2 sequence alignment analysis of the full-length sequence shown in FIG. 296 (SEQ ID NO:414), evidenced significant homology between the PRO1270 amino acid sequence and the following Dayhoff sequences: XLU86699_1, S49589, FIBA_PARPA, FIBB_HUMAN, P_R47189, AF004326_1, DRTENASCN_1, AF004327_1, P_W01411 and FIBG_BOVIN.

Example 134

Isolation of cDNA Clones Encoding Human PRO1271

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57955.

In light of an observed sequence homology between the DNA57955 consensus sequence and an EST sequence encompassed within the Merck EST clone no. AA625350, the Merck EST clone AA625350 was purchased and the cDNA insert was obtained and sequenced. It was found that this insert encoded a full-length protein. The sequence of this cDNA insert is shown in FIG. 297 and is herein designated as DNA66309-1538.

Clone DNA66309-1538 contains a single open reading frame with an apparent translational initiation site at nucleotide positions 94–96 and ending at the stop codon at nucleotide positions 718–720 (FIG. 297). The predicted polypeptide precursor is 208 amino acids long (FIG. 298). The full-length PRO1271 protein shown in FIG. 298 has an estimated molecular weight of about 21,531 daltons and a pI of about 8.99. Analysis of the full-length PRO1271 sequence shown in FIG. 298 (SEQ ID NO:416) evidences the presence of the following: a signal peptide from about amino acid 1 to about amino acid 31 and a transmembrane domain from about amino acid 166 to about amino acid 187. Clone DNA66309-1538 has been deposited with ATCC on Sep. 15, 1998 and is assigned ATCC deposit no. 203235.

An analysis of the Dayhoff database (version 35.45 SwissProt 35), using a WU-BLAST2 sequence alignment analysis of the full-length sequence shown in FIG. 298 (SEQ ID NO:416), evidenced significant homology between the PRO1271 amino acid sequence and the following Dayhoff sequences: S57180, S63257, AGAL_YEAST, BPU43599_1, YS8A_CAEEL, S67570, LSU54556_2, S70305, VGLX_HSVEB, and D88733_1.

Example 135

Isolation of cDNA Clones Encoding Human PRO1375

A Merck/Wash. U. database was searched and a Merck EST was identified. This sequence was then put in a program which aligns it with other sequences from the Swiss-Prot public database, public EST databases (e.g., GenBank, Merck/Wash. U.), and a proprietary EST database (LIFESEQ®, Incyte Pharmaceuticals, Palo Alto, Calif.). The search was performed using the computer program BLAST or BLAST2 [Altschul et al., *Methods in Enzymology*, 266:460–480 (1996)] as a comparison of the extracellular domain (ECD) protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence was assembled relative to other EST sequences using phrap. This consensus sequence is designated herein "DNA67003".

Based on the DNA67003 consensus sequence, the nucleic acid (SEQ ID NO:417) was identified in a human pancreas library. DNA sequencing of the clone gave the full-length DNA sequence for PRO1375 and the derived protein sequence for PRO1375.

The entire coding sequence of PRO1375 is shown in FIG. 299 (SEQ ID NO:417). Clone DNA67004-1614 contains a single open reading frame with an apparent translational initiation site at nucleotide positions 104–106 and an apparent stop codon at nucleotide positions 698–700 of SEQ ID NO:417. The predicted polypeptide precursor is 198 amino acids long. The transmembrane domains are at about amino acids 11–28 (type II) and 103–125 of SEQ ID NO:418. Clone DNA67004-1614 has been deposited with ATCC and is assigned ATCC deposit no. 203115. The full-length PRO1375 protein shown in FIG. 300 has an estimated molecular weight of about 22,531 daltons and a pI of about 8.47.

An analysis of the Dayhoff database (version 35.45 SwissProt 35), using a WU-BLAST2 sequence alignment analysis of the full-length sequence shown in FIG. 300 (SEQ ID NO:418), revealed sequence identity between the PRO1375 amino acid sequence and the following Dayhoff sequences: AF026198_5, CELR12C12_5, S73465, Y011_MYCPN, S64538_1, P_P8150, MUVSHPO10_1, VSH_MUMPL and CVU59751_5.

Example 136

Isolation of cDNA Clones Encoding Human PRO1385

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57952.

In light of an observed sequence homology between the DNA57952 consensus sequence and an EST sequence encompassed within the Incyte EST clone no. 3129630, the Incyte EST clone 3129630 was purchased and the cDNA insert was obtained and sequenced. It was found that this insert encoded a full-length protein. The sequence of this cDNA insert is shown in FIG. 301 and is herein designated as DNA68869-1610.

Clone DNA68869-1610 contains a single open reading frame with an apparent translational initiation site at nucleotide positions 26–28 and ending at the stop codon at nucleotide positions 410–412 (FIG. 301). The predicted polypeptide precursor is 128 amino acids long (FIG. 302). The full-length PRO1385 protein shown in FIG. 302 has an estimated molecular weight of about 13,663 daltons and a pI of about 10.97. Analysis of the full-length PRO1385 sequence shown in FIG. 302 (SEQ ID NO:420) evidences the presence of the following: a signal peptide from about amino acid 1 to about amino acid 28, and glycosylaminoglycan attachment sites from about amino acid 82 to about amino acid 85 and from about amino acid 91 to about amino acid 94. Clone DNA68869-1610 has been deposited with ATCC on Aug. 25, 1998 and is assigned ATCC deposit no. 203164.

An analysis of the Dayhoff database (version 35.45 SwissProt 35), using a WU-BLAST2 sequence alignment analysis of the full-length sequence shown in FIG. 302 (SEQ ID NO:420), evidenced low homology between the PRO1385 amino acid sequence and the following Dayhoff sequences: CELT14A8_1, LMNACHRA1_1, HXD9_HUMAN, CHKCMLF_1, HS5PP34_2, DMDRING_1, A37107_1, MMLUNGENE_1, PUM_DROME and DMU25117_1.

Example 137

Isolation of cDNA Clones Encoding Human PRO1387

Use of the signal sequence algorithm described in Example 3 above allowed identification of a single EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56259.

In light of an observed sequence homology between the DNA56259 consensus sequence and an EST sequence encompassed within the Incyte EST clone no. 3507924, the Incyte EST clone 3507924 was purchased and the cDNA insert was obtained and sequenced. It was found that this insert encoded a full-length protein. The sequence of this cDNA insert is shown in FIG. 303 and is herein designated as DNA68872-1620.

Clone DNA68872-1620 contains a single open reading frame with an apparent translational initiation site at nucleotide positions 85–87 and ending at the stop codon at nucleotide positions 1267–1269 (FIG. 303). The predicted polypeptide precursor is 394 amino acids long (FIG. 304). The full-length PRO1387 protein shown in FIG. 304 has an estimated molecular weight of about 44,339 daltons and a pI of about 7.10. Analysis of the full-length PRO1387 sequence shown in FIG. 304 (SEQ ID NO:422) evidences the presence of the following: a signal peptide from about amino acid 1 to about amino acid 19, a transmembrane domain from about amino acid 275 to about amino acid 296, potential N-glycosylation sites from about amino acid 76 to about amino acid 79, from about amino acid 231 to about amino acid 234, from about amino acid 302 to about amino acid 305, from about amino acid 307 to about amino acid 310 and from about amino acid 376 to about amino acid 379, and amino acid sequence blocks having homology to myelin p0 protein from about amino acid 210 to about amino acid 239 and from about amino acid 92 to about amino acid 121. Clone DNA68872-1620 has been deposited with ATCC on Aug. 25, 1998 and is assigned ATCC deposit no. 203160.

An analysis of the Dayhoff database (version 35.45 SwissProt 35), using a WU-BLAST2 sequence alignment analysis of the full-length sequence shown in FIG. 304 (SEQ ID NO:422), evidenced significant homology between the PRO1387 amino acid sequence and the following Dayhoff sequences: P_W36955, MYP0_HETFR, HS46KDA_1, AF049498_1, MYO0_HUMAN, AF030454_1, A53268, SHPTCRA_1, P_W14146 and GEN12838.

Example 138

Isolation of cDNA Clones Encoding Human PRO1384

A consensus DNA sequence was assembled relative to other EST sequences using phrap as described in Example 1 above. This consensus sequence is herein designated DNA54192. Based on the DNA54192 sequence, oligonucleotides were synthesized: 1) to identify by PCR a cDNA library that contained the sequence of interest, and 2) for use as probes to isolate a clone of the full-length coding sequence for PRO1384.

PCR primers (forward and reverse) were synthesized:

```
forward PCR primer 5'-TGCAGCCCCTGTGACACAAACTGG-3'    (SEQ ID NO:425)
reverse PCR primer 5'-CTGAGATAACCGAGCCATCCTCCCAC-3'  (SEQ ID NO:426)
```

Additionally, a synthetic oligonucleotide hybridization probe was constructed from the DNA54192 sequence which had the following nucleotide sequence:

Hybridization Probe

5'-GGAGATAGCTGCTATGGGTTCTTCAGGCACAA CTTAACATGGGAAG-3' (SEQ ID NO:427)

In order to screen several libraries for a source of a full-length clone, DNA from the libraries was screened by PCR amplification with the PCR primer pair identified above. A positive library was then used to isolate clones encoding the PRO1384 gene using the probe oligonucleotide and one of the PCR primers. RNA for construction of the cDNA libraries was isolated from human fetal liver.

DNA sequencing of the clones isolated as described above gave the full-length DNA sequence for PRO1384 (designated herein as DNA71159-1617 [FIG. 305, SEQ ID NO:423]; and the derived protein sequence for PRO1384.

The entire coding sequence of PRO1384 is shown in FIG. 305 (SEQ ID NO:423). Clone DNA71159-1617 contains a single open reading frame with an apparent translational initiation site at nucleotide positions 182–184 and an apparent stop codon at nucleotide positions 869–871. The predicted polypeptide precursor is 229 amino acids long. The full-length PRO1384 protein shown in FIG. 306 has an estimated molecular weight of about 26,650 daltons and a pI of about 8.76. Additional features include a type II transmembrane domain at about amino acids 32–57, and potential N-glycosylation sites at about amino acids 68–71, 120–123, and 134–137.

An analysis of the Dayhoff database (version 35.45 SwissProt 35), using a WU-BLAST2 sequence alignment analysis of the full-length sequence shown in FIG. 306 (SEQ ID NO:424), revealed homology between the PRO1384 amino acid sequence and the following Dayhoff sequences: AF054819_1, HSAM1687_1, AF009511_1, AB010710_1, GEN13595, HSAJ673_1, GEN13961, AB005900_1, LECH_CHICK, AF021349_1, and NK13_RAT.

Clone DNA71159-1617 has been deposited with ATCC and is assigned ATCC deposit no. 203135.

Example 139

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formamide, 5×SSC, 0.1% SDS, 0.1% sodium pyrophosphate, 50 mM sodium phosphate, pH 6.8, 2×Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 140

Expression of PRO in E. coli

This example illustrates preparation of an unglycosylated form of PRO by recombinant expression in E. coli.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the PRO coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in E. coli in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an E. coli host based on strain 52 (W3110 fuhA(tonA) lon galE rpoHts(htpRts) clpP(lacIq). Transformants are first grown in LB containing 50 mg/ml carbenicillin at 30° C. with shaking until an O.D.600 of 3–5 is reached. Cultures are then diluted 50–100 fold into CRAP media (prepared by mixing 3.57 g $(NH_4)_2SO_4$, 0.71 g sodium citrate.$2H_2O$, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20–30 hours at 30° C. with shaking. Samples are removed to verify expression by SDS-PAGE analysis, and the bulk culture is centrifuged to pellet the cells. Cell pellets are frozen until purification and refolding.

E. coli paste from 0.5 to 1 L fermentations (6–10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3–5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12–36 hours. The refolding reaction is quenched by the addition of TFA to a final concentration of 0.4% (pH of approximately 3). Before further purification of the protein, the solution is filtered through a 0.22 micron filter and acetonitrile is added to 2–10% final concentration. The refolded protein is chromatographed on a Poros R1/H reversedphase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 141

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 µg pRK5-PRO DNA is mixed with about 1 µg DNA encoding the VA RNA gene [Thimmappaya et al., Cell, 31:543 (1982)] and dissolved in 500 µl of 1 mM Tris-HCl, 0.1 mM EDTA, 0.227 M $CaCl_2$. To this mixture is added, dropwise, 500 µl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 µCi/ml $^{35}$S-cysteine and 200 µCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., Proc. Natl. Acad. Sci., 12:7575 (1981). 293 cells are grown to maximal density in a spinner flask and 700 µg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774–1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Quiagen), Dosper® or Fugene® (Boehringer Mannheim). The cells are grown as described in Lucas et al., supra. Approximately $3 \times 10^{-7}$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 μm filtered PS20 with 5% 0.2 μm diafiltered fetal bovine serum). The cells are then aliquoted into a 100 mL spinner containing 90 mL of selective media. After 1–2 days, the cells are transferred into a 250 mL spinner filled with 150 mL selective growth medium and incubated at 37° C. After another 2–3 days, 250 mL, 500 mL and 2000 mL spinners are seeded with $3 \times 10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3L production spinner is seeded at $1.2 \times 10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 μm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4–5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at –80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 μL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 142

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 143

Expression of PRO in Baculovirus-infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera fugiperda* ("Sf9") cells (ATCC CRL 1711) using lipofectin (commercially available from GIBCO-BRL). After 4–5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature*, 362:175–179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 μm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Many of the PRO polypeptides disclosed herein were successfully expressed as described above.

Example 144

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1–100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3×63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 145

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2–3, or a high concentration of a chaotrope such as urea or thiocyanate ion), and PRO polypeptide is collected.

Example 146

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 147

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology*, 9: 19–21 (1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry* 31:7796–7801 (1992) or which act as inhibitors, agonists, or antagonists of native peptides as shown by Athauda et al., *J. Biochem.*, 113:742–746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 148

Stimulation of Heart Neonatal Hypertrophy (Assay 1)

This assay is designed to measure the ability of PRO polypeptides to stimulate hypertrophy of neonatal heart. PRO polypeptides testing positive in this assay are expected to be useful for the therapeutic treatment of various cardiac insufficiency disorders.

Cardiac myocytes from 1-day old Harlan Sprague Dawley rats were obtained. Cells (180 $\mu$l at $7.5 \times 10^4$/ml, serum <0.1%, freshly isolated) are added on day 1 to 96-well plates previously coated with DMEM/F12+4% FCS. Test samples containing the test PRO polypeptide or growth medium only (hegative control) (20 $\mu$l/well) are added directly to the wells on day 1. PGF (20 µl/well) is then added on day 2 at final concentration of $10^{-6}$ M. The cells are then stained on day 4 and visually scored on day 5, wherein cells showing no increase in size as compared to negative controls are scored 0.0, cells showing a small to moderate increase in size as compared to negative controls are scored 1.0 and cells showing a large increase in size as compared to negative controls are scored 2.0. A positive result in the assay is a score of 1.0 or greater.

The following polypeptides tested positive in this assay: PRO1312.

Example 149

Stimulation of Endothelial Cell Proliferation (Assay 8)

This assay is designed to determine whether PRO polypeptides of the present invention show the ability to stimulate adrenal cortical capillary endothelial cell (ACE) growth. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Bovine adrenal cortical capillary endothelial (ACE) cells (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus VEGF (5 ng/ml); and (4) ACE cells plus FGF (5 ng/ml). The control or test sample, (in 100 microliter volumes), was then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.µM sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of a PRO polypeptide was calculated as the fold increase in proliferation (as determined by the acid phosphatase activity, OD 405 µm) relative to (1) cell only background, and (2) relative to maximum stimulation by VEGF. VEGF (at 3–10 ng/ml) and FGF (at 1–5 ng/ml) were employed as an activity reference for maximum stimulation. Results of the assay were considered "positive" if the observed stimulation was >50% increase over background. VEGF (5 ng/ml) control at 1% dilution gave 1.24 fold stimulation; FGF (5 ng/ml) control at 1% dilution gave 1.46 fold stimulation.

The following PRO polypeptides tested positive in this assay: PRO1154 and PRO1186.

Example 150

Inhibition of Vascular Endothelial Growth Factor (VEGF) Stimulated Proliferation of Endothelial Cell Growth (Assay 9)

The ability of various PRO polypeptides to inhibit VEGF stimulated proliferation of endothelial cells was tested. Polypeptides testing positive in this assay are useful for inhibiting endothelial cell growth in mammals where such an effect would be beneficial, e.g., for inhibiting tumor growth.

Specifically, bovine adrenal cortical capillary endothelial cells (ACE) (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus 5 ng/ml FGF; (4) ACE cells plus 3 ng/ml VEGF; (5) ACE cells plus 3 ng/ml VEGF plus 1 ng/ml TGF-beta; and (6) ACE cells plus 3 ng/ml VEGF plus 5 ng/ml LIF. The test samples, poly-his tagged PRO polypeptides (in 100 microliter volumes), were then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of PRO polypeptides was calculated as the percent inhibition of VEGF (3 ng/ml) stimulated proliferation (as determined by measuring acid phosphatase activity at OD 405 µm) relative to the cells without stimulation. TGF-beta was employed as an activity reference at 1 ng/ml, since TGF-beta blocks 70–90% of VEGF-stimulated ACE cell proliferation. The results are indicative of the utility of the PRO polypeptides in cancer therapy and specifically in inhibiting tumor angiogenesis. Numerical values (relative inhibition) are determined by calculating the percent inhibition of VEGF stimulated proliferation by the PRO polypeptides relative to cells without stimulation and then dividing that percentage into the percent inhibition obtained by TGF-β at 1 ng/ml which is known to block 70–90% of VEGF stimulated cell proliferation. The results are considered positive if the PRO polypeptide exhibits 30% or greater inhibition of VEGF stimulation of endothelial cell growth (relative inhibition 30% or greater).

The following polypeptide tested positive in this assay: PRO812.

Example 151

Stimulatory Activity in Mixed Lymphocyte Reaction (MLR) Assay (Assay 24)

This example shows that certain polypeptides of the invention are active as a stimulator of the proliferation of stimulated T-lymphocytes. Compounds which stimulate proliferation of lymphocytes are useful therapeutically where enhancement of an immune response is beneficial. A therapeutic agent may take the form of antagonists of the polypeptide of the invention, for example, murine-human chimeric, humanized or human antibodies against the polypeptide.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:

100:1 of test sample diluted to 1% or to 0.1%,

50:1 of irradiated stimulator cells, and

50:1 of responder PBMC cells.
100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Positive increases over control are considered positive with increases of greater than or equal to 180% being preferred. However, any value greater than control indicates a stimulatory effect for the test protein.

The following PRO polypeptides tested positive in this assay: PRO826, PRO1068, PRO1184, PRO1346 and PRO1375.

Example 152

Retinal Neuron Survival (Assay 52)

This example demonstrates that certain PRO polypeptides have efficacy in enhancing the survival of retinal neuron cells and, therefore, are useful for the therapeutic treatment of retinal disorders or injuries including, for example, treating sight loss in mammals due to retinitis pigmentosum, AMD, etc.

Sprague Dawley rat pups at postnatal day 7 (mixed population: glia and retinal neuronal types) are killed by decapitation following $CO_2$ anesthesia and the eyes are removed under sterile conditions. The neural retina is dissected away from the pigment epithelium and other ocular tissue and then dissociated into a single cell suspension using 0.25% trypsin in $Ca^{2+}$, $Mg^{2+}$-free PBS. The retinas are incubated at 37° C. for 7–10 minutes after which the trypsin is inactivated by adding 1 ml soybean trypsin inhibitor. The cells are plated at 100,000 cells per well in 96 well plates in DMEM/F12 supplemented with N2 and with or without the specific test PRO polypeptide. Cells for all experiments are grown at 37° C. in a water saturated atmosphere of 5% $CO_2$. After 2–3 days in culture, cells are stained with calcein AM then fixed using 4% paraformaldehyde and stained with DAPI for determination of total cell count. The total cells (fluorescent) are quantified at 20x objective magnification using CCD camera and NIH image software for MacIntosh. Fields in the well are chosen at random.

The effect of various concentration of PRO polypeptides are reported herein where percent survival is calculated by dividing the total number of calcein AM positive cells at 2–3 days in culture by the total number of DAPI-labeled cells at 2–3 days in culture. Anything above 30% survival is considered positive.

The following PRO polypeptides tested positive in this assay using polypeptide concentrations within the range of 0.01% to 1.0% in the assay: PRO828, PRO826, PRO1068 and PRO1132.

Example 153

Rod Photoreceptor Cell Survival (Assay 56)

This assay shows that certain polypeptides of the invention act to enhance the survival/proliferation of rod photoreceptor cells and, therefore, are useful for the therapeutic treatment of retinal disorders or injuries including, for example, treating sight loss in mammals due to retinitis pigmentosum, AMD, etc.

Sprague Dawley rat pups at 7 day postnatal (mixed population: glia and retinal neuronal cell types) are killed by decapitation following $CO_2$ anesthesis and the eyes are removed under sterile conditions. The neural retina is dissected away form the pigment epithelium and other ocular tissue and then dissociated into a single cell suspension using 0.25% trypsin in $Ca^{2+}$, $Mg^{2+}$-free PBS. The retinas are incubated at 37° C. for 7–10 minutes after which the trypsin is inactivated by adding 1 ml soybean trypsin inhibitor. The cells are plated at 100,000 cells per well in 96 well plates in DMEM/F12 supplemented with $N_2$. Cells for all experiments are grown at 37° C. in a water saturated atmosphere of 5% $CO_2$. After 2–3 days in culture, cells are fixed using 4% paraformaldehyde, and then stained using CellTracker Green CMFDA. Rho 4D2 (ascites or IgG 1:100), a monoclonal antibody directed towards the visual pigment rhodopsin is used to detect rod photoreceptor cells by indirect immunofluorescence. The results are calculated as % survival: total number of calcein—rhodopsin positive cells at 2–3 days in culture, divided by the total number of rhodopsin positive cells at time 2–3 days in culture. The total cells (fluorescent) are quantified at 20x objective magnification using a CCD camera and NIH image software for MacIntosh. Fields in the well are chosen at random.

The following polypeptides tested positive in this assay: PRO536, PRO943, PRO828, PRO826, PRO1068 and PRO1132.

Example 154

Induction of c-fos in Endothelial Cells (Assay 34)

This assay is designed to determine whether PRO polypeptides show the ability to induce c-fos in endothelial cells. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Human venous umbilical vein endothelial cells (HUVEC, Cell Systems) in growth media (50% Ham's F12 w/o GHT:

low glucose, and 50% DMEM without glycine: with NaHCO3, 1% glutamine, 10 mM HEPES, 10% FBS, 10 ng/ml bFGF) were plated on 96-well microtiter plates at a cell density of $1 \times 10^4$ cells/well. The day after plating, the cells were starved by removing the growth media and treating the cells with 100 μl/well test samples and controls (positive control=growth media; negative control=Protein 32 buffer=10 mM HEPES, 140 mM NaCl, 4% (w/v) mannitol, pH 6.8). The cells were incubated for 30 minutes at 37° C., in 5% $CO_2$. The samples were removed, and the first part of the bDNA kit protocol (Chiron Diagnostics, cat. #6005–037) was followed, where each capitalized reagent/buffer listed below was available from the kit.

Briefly, the amounts of the TM Lysis Buffer and Probes needed for the tests were calculated based on information provided by the manufacturer. The appropriate amounts of thawed Probes were added to the TM Lysis Buffer. The Capture Hybridization Buffer was warmed to room temperature. The bDNA strips were set up in the metal strip holders, and 100 μl of Captuie Hybridization Buffer was added to each b-DNA well needed, followed by incubation for at least 30 minutes. The test plates with the cells were removed from the incubator, and the media was gently removed using the vacuum manifold. 100 μl of Lysis Hybridization Buffer with Probes were quickly pipetted into each well of the microtiter plates. The plates were then incubated at 55° C. for 15 minutes. Upon removal from the incubator, the plates were placed on the vortex mixer with the microtiter adapter head and vortexed on the #2 setting for one minute. 80 μl of the lysate was removed and added to the bDNA wells containing the Capture Hybridization Buffer, and pipetted up and down to mix. The plates were incubated at 53° C. for at least 16 hours.

On the next day, the second part of the bDNA kit protocol was followed. Specifically, the plates were removed from the incubator and placed on the bench to cool for 10 minutes. The volumes of additions needed were calculated based upon information provided by the manufacturer. An Amplifier Working Solution was prepared by making a 1:100 dilution of the Amplifier Concentrate (20 fm/μl) in AL Hybridization Buffer. The hybridization mixture was removed from the plates and washed twice with Wash A. 50 μl of Amplifier Working Solution was added to each well and the wells were incubated at 53° C. for 30 minutes. The plates were then removed from the incubator and allowed to cool for 10 minutes. The Label Probe Working Solution was prepared by making a 1:100 dilution of Label Concentrate (40 pmoles/μl) in AL Hybridization Buffer. After the 10-minute cool-down period, the amplifier hybridization mixture was removed and the plates were washed twice with Wash A. 50 μl of Label Probe Working Solution was added to each well and the wells were incubated at 53° C. for 15 minutes. After cooling for 10 minutes, the Substrate was warmed to room temperature. Upon addition of 3 μl of Substrate Enhancer to each ml of Substrate needed for the assay, the plates were allowed to cool for 10 minutes, the label hybridization mixture was removed, and the plates were washed twice with Wash A and three times with Wash D. 50 μl of the Substrate Solution with Enhancer was added to each well. The plates were incubated for 30 minutes at 37° C. and RLU was read in an appropriate luminometer.

The replicates were averaged and the coefficient of variation was determined. The measure of activity of the fold increase over the negative control (Protein 32/HEPES buffer described above) value was indicated by chemiluminescence units (RLU). The results are considered positive if the PRO polypeptide exhibits at least a two-fold value over the negative buffer control. Negative control=1.00 RLU at 1.00% dilution. Positive control=8.39 RLU at 1.00% dilution.

The following PRO polypeptides tested positive in this assay: PRO535, PRO826, PRO819, PRO1126, PRO1160 and PRO1387.

Example 155

Inhibitory Activity in Mixed Lymphocyte Reaction (MLR) Assay (Assay 67)

This example shows that one or more of the polypeptides of the invention are active as inhibitors of the proliferation of stimulated T-lymphocytes. Compounds which inhibit proliferation of lymphocytes are useful therapeutically where suppression of an immune response is beneficial.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3 \times 10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:
100:1 of test sample diluted to 1% or to 0.1%,
50:1 of irradiated stimulator cells, and
50:1 of responder PBMC cells.
100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Any decreases below control is considered to be a positive result for an inhibitory compound, with decreases of less than or equal to 80% being preferred. However, any value less than control indicates an inhibitory effect for the test protein.

The following polypeptide tested positive in this assay: PRO1114, PRO836, PRO1159, PRO1312, PRO1192, PRO1195 and PRO1387.

Example 156

Mouse Kidney Mesangial Cell Proliferation Assay (Assay 92)

This assay shows that certain polypeptides of the invention act to induce proliferation of mammalian kidney mesangial cells and, therefore, are useful for treating kidney disorders associated with decreased mesangial cell function such as Berger disease or other nephropathies associated with Schonlein-Henoch purpura, celiac disease, dermatitis herpetiformis or Crohn disease. The assay is performed as follows. On day one, mouse kidney mesangial cells are plated on a 96 well plate in growth media (3:1 mixture of Dulbecco's modified Eagle's medium and Ham's F12 medium, 95% fetal bovine serum, 5% supplemented with 14 mM HEPES) and grown overnight. On day 2, PRO polypeptides are diluted at 2 concentrations(1 % and 0.1%) in serum-free medium and added to the cells. Control samples are serum-free medium alone. On day 4, 20 µl of the Cell Titer 96 Aqueous one solution reagent (Progema) was added to each well and the colormetric reaction was allowed to proceed for 2 hours. The absorbance (OD) is then measured at 490 µm. A positive in the assay is anything that gives an absorbance reading which is at least 15% above the control reading.

The following polypeptide tested positive in this assay: PRO819, PRO813 and PRO1066.

Example 157

Pericyte c-Fos Induction (Assay 93)

This assay shows that certain polypeptides of the invention act to induce the expression of c-fos in pericyte cells and, therefore, are useful not only as diagnostic markers for particular types of pericyte-associated tumors but also for giving rise to antagonists which would be expected to be useful for the therapeutic treatment of pericyte-associated tumors. Specifically, on day 1, pericytes are received from VEC Technologies and all but 5 ml of media is removed from flask. On day 2, the pericytes are trypsinized, washed, spun and then plated onto 96 well plates. On day 7, the media is removed and the pericytes are treated with 100 µl of PRO polypeptide test samples and controls (positive control=DME+5% serum +/− PDGF at 500 ng/ml; negative control=protein 32). Replicates are averaged and SD/CV are determined. Fold increase over Protein 32 (buffer control) value indicated by chemiluminescence units (RLU) luminometer reading verses frequency is plotted on a histogram. Two-fold above Protein 32 value is considered positive for the assay. ASY Matrix: Growth media=low glucose DMEM=20% FBS+1× pen strep+1× fungizone. Assay Media=low glucose DMEM+5% FBS.

The following polypeptides tested positive in this assay: PRO943 and PRO819.

Example 158

Detection of PRO Polypeptides That Affect Glucose or FFA Uptake by Primary Rat Adipocytes (Assay 94)

This assay is designed to determine whether PRO polypeptides show the ability to affect glucose or FFA uptake by adipocyte cells. PRO polypeptides testing positive in this assay would be expected to be useful for the therapeutic treatment of disorders where either the stimulation or inhibition of glucose uptake by adipocytes would be beneficial including, for example, obesity, diabetes or hyper- or hypo-insulinemia.

In a 96 well format, PRO polypeptides to be assayed are added to primary rat adipocytes, and allowed to incubate overnight. Samples are taken at 4 and 16 hours and assayed for glycerol, glucose and FFA uptake. After the 16 hour incubation, insulin is added to the media and allowed to incubate for 4 hours. At this time, a sample is taken and glycerol, glucose and FFA uptake is measured. Media containing insulin without the PRO polypeptide is used as a positive reference control. As the PRO polypeptide being tested may either stimulate or inhibit glucose and FFA uptake, results are scored as positive in the assay if greater than 1.5 times or less than 0.5 times the insulin control.

The following PRO polypeptides tested positive as stimulators of glucose and/or FFA uptake in this assay: PRO1114, PRO1007, PRO1066, PRO848, PRO1182, PRO1198, PRO1192, PRO1271, PRO1375 and PRO1387.

The following PRO polypeptides tested positive as inhibitors of glucose and/or FFA uptake in this assay: PRO1184, PRO1360, PRO1309, PRO1154, PRO1181, PRO1186, PRO1160 and PRO1384.

Example 159

Chondrocyte Re-differentiation Assay (Assay 110)

This assay shows that certain polypeptides of the invention act to induce redifferentiation of chondrocytes, therefore, are expected to be useful for the treatment of various bone and/or cartilage disorders such as, for example, sports injuries and arthritis. The assay is performed as follows. Porcine chondrocytes are isolated by overnight collagenase digestion of articulary cartilage of metacarpophalangeal joints of 4–6 month old female pigs. The isolated cells are then seeded at 25,000 cells/cm$^2$ in Ham F-12 containing 10% FBS and 4 µg/ml gentamycin. The culture media is changed every third day and the cells are then seeded in 96 well plates at 5,000 cells/well in 100 µl of the same media without serum and 100 µl of the test PRO polypeptide, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

The following polypeptide tested positive in this assay: PRO1282, PRO1310, PRO619, PRO943, PRO820, PRO1080, PRO1016, PRO1007, PRO1056, PRO791, PRO1111, PRO1184, PRO1360, PRO1309, PRO1107, PRO1132, PRO1131, PRO848, PRO1181, PRO1186, PRO1159, PRO1312, PRO1192 and PRO1384.

Example 160

Chondrocyte Proliferation Assay (Assay 111)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4–6 month old female pigs. The isolated cells are then seeded at 25,000 cells/cm$^2$ in Ham F-12 containing 10% FBS and 4 µg/ml gentamycin. The culture media is changed every third day and the cells are reseeded to 25,000 cells/cm$^2$ every five days. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 20 µl of Alamar blue is added to each well and the plates are incubated for an additional 3 hours at 37° C. The fluorescence is then measured in each well (Ex:530 µm; Em: 590 µm). The fluorescence of a plate containing 200 µl of the serum-free medium is measured to obtain the background. A positive result in the assay is obtained when the fluorescence of the PRO polypeptide treated sample is more like that of the positive control than the negative control.

The following PRO polypeptides tested positive in this assay: PRO1310, PRO844, PRO1312, PRO1192 and PRO1387.

Example 161

Induction of Pancreatic β-Cell Precursor Proliferation (Assay 117)

This assay shows that certain polypeptides of the invention act to induce an increase in the number of pancreatic β-cell precursor cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either β-cell precursors or mature β-cells. Marker expression is measured by real time quantitative PCR (RTQ-PCR); wherein the marker being evaluated is a transcription factor called Pdx1.

The pancreata are dissected from E14 embryos (CD1 mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPMI1640. At day 1, the cells are seeded into 12-well tissue culture plates (pre-coated with laminin, 20 µg/ml in PBS, Boehringer Manmheim, #124317). Cells from pancreata from 1–2 embryos are distributed per well. The culture medium for this primary cuture is 14F/1640. At day 2, the media is removed and the attached cells washed with RPMI/1640. Two mls of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls. 14F/1640 is RPMI1640 (Gibco) plus the following:

group A 1:1000
group B 1:1000
recombinant human insulin 10 µg/ml
Aprotinin (50 µg/ml) 1:2000 (Boehringer manheim #981532)
Bovine pituitary extract (BPE) 60 µg/ml
Gentamycin 100 ng/ml
Group A: (in 10 ml PBS)
 Transferrin, 100 mg (Sigma T2252)
 Epidermal Growth Factor, 100 µg (BRL 100004)
 Triiodothyronine, 10 µl of $5\times10^{-6}$ M (Sigma T5516)
 Ethanolamine, 100 µl of $10^{-1}$ M (Sigma E0135)
 Phosphoethalamine, 100 µl of $10^{-1}$ M (Sigma P0503)
 Selenium, 4 µl of $10^{-1}$ M (Aesar #12574)

Group C: (in 10 ml 100% ethanol)
 Hydrocortisone, 2 µl of $5\times10^{-3}$ M (Sigma #H0135)
 Progesterone, 100 µl of $1\times10^{-3}$ M (Sigma #P6149)
 Forskolin, 500 µl of 20 mM (Calbiochem #344270)
Minimal Media:
 RPMI 1640 plus transferrin (10 µg/ml), insulin (1 µg/µl), gentamycin (100 ng/ml), aprotinin (50 µg/ml) and BPE (15 µg/ml).
Defined Media:
 RPMI 1640 plus transferrin (10 µg/ml), insulin (1 µg/ml), gentamycin (100 ng/ml) and aprotinin (50 µg/ml).

The following polypeptides tested positive in this assay: PRO1310, PRO1188, PRO1131 and PRO1387.

Example 162

Detection of Polypeptides That Affect Glucose or FFA Uptake in Skeletal Muscle (Assay 106)

This assay is designed to determine whether PRO polypeptides show the ability to affect glucose or FFA uptake by skeletal muscle cells. PRO polypeptides testing positive in this assay would be expected to be useful for the therapeutic treatment of disorders where either the stimulation or inhibition of glucose uptake by skeletal muscle would be beneficial including, for example, diabetes or hyper- or hypo-insulinemia.

In a 96 well format, PRO polypeptides to be assayed are added to primary rat differentiated skeletal muscle, and allowed to incubate overnight. Then fresh media with the PRO polypeptide and +/− insulin are added to the wells. The sample media is then monitored to determine glucose and FFA uptake by the skeletal muscle cells. The insulin will stimulate glucose and FFA uptake by the skeletal muscle, and insulin in media without the PRO polypeptide is used as a positive control, and a limit for scoring. As the PRO polypeptide being tested may either stimulate or inhibit glucose and FFA uptake, results are scored as positive in the assay if greater than 1.5 times or less than 0.5 times the insulin control.

The following PRO polypeptides tested positive as either stimulators or inhibitors of glucose and/or FFA uptake in this assay: PRO358, PRO1016, PRO1007, PRO826, PRO1066, PRO1029 and PRO1309.

Example 163

Fetal Hemoglobin Induction in an Erythroblastic Cell Line (Assay 107)

This assay is useful for screening PRO polypeptides for the ability to induce the switch from adult hemoglobin to fetal hemoglobin in an erythroblastic cell line. Molecules testing positive in this assay are expected to be useful for therapeutically treating various mammalian hemoglobin-associated disorders such as the various thalassemias. The assay is performed as follows. Erythroblastic cells are plated in standard growth medium at 1000 cells/well in a 96 well format. PRO polypeptides are added to the growth medium at a concentration of 0.2% or 2% and the cells are incubated for 5 days at 37° C. As a positive control, cells are treated with 100 µM hemin and as a negative control, the cells are untreated. After 5 days, cell lysates are prepared and analyzed for the expression of gamma globin (a fetal marker). A positive in the assay is a gamma globin level at least 2-fold above the negative control.

The following polypeptides tested positive in this assay: PRO1114, PRO826, PRO1066, PRO844, PRO1192 and PRO1358.

Example 164

Induction of Pancreatic β-Cell Precursor Differentiation (Assay 89)

This assay shows that certain polypeptides of the invention act to induce differentiation of pancreatic β-cell precursor cells into mature pancreatic β-cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either P-cell precursors or mature β-cells. Marker expression is measured by real time quantitative PCR (RTQ-PCR); wherein the marker being evaluated is insulin.

The pancreata are dissected from E14 embryos (CDI mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPMI1640. At day 1, the cells are seeded into 12-well tissue culture plates (pre-coated with laminin, 20 μg/ml in PBS, Boehringer Mannheim, #124317). Cells from pancreata from 1–2 embryos are distributed per well. The culture medium for this primary cuture is 14F/1640. At day 2, the media is removed and the attached cells washed with RPMI/1640. Two mils of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls. 14F/1640 is RPMI1640 (Gibco) plus the following:

group A 1:1000
group B 1:1000
recombinant human insulin 10 μg/ml
Aprotinin (50 μg/ml) 1:2000 (Boehringer manheim #981532)
Bovine pituitary extract (BPE) 60, μg/ml
Gentamycin 100 ng/ml Group A: (in 10 ml PBS)
Transferrin, 100 mg (Sigma T2252)
Epidermal Growth Factor, 100 μg (BRL 100004)
Triiodothyronine, 10 μl of $5 \times 10^{-6}$ M (Sigma T5516)
Ethanolamine, 100 μl of $10^{-1}$ M (Sigma E0135)
Phosphoethalamine, 100 μl of $10^{-1}$ M (Sigma P0503)
Selenium, 4 μl of $10^{-1}$ M (Aesar #12574)

Group C: (in 10 ml 100% ethanol)
Hydrocortisone, 2 μl of $5 \times 10^{-3}$ M (Sigma #H0135)
Progesterone, 100 μl of $1 \times 10^{-3}$ M (Sigma #P6149)
Forskolin, 500 μl of 20 mM (Calbiochem #344270)

Minimal Media:
RPMI 1640 plus transferrin (10 μg/ml), insulin (1 μg/ml), gentamycin (100 ng/ml), aprotinin (50 μg/ml) and BPE (15 μg/ml).

Defined Media:
RPMI 1640 plus transferrin (10 μg/ml), insulin (1 μg/ml), gentamycin (100 ng/ml) and aprotinin (50 μg/ml).

The following polypeptides were positive in this assay: PRO1188, PRO1132, PRO1131 and PRO1181.

Example 165

Skin Vascular Permeability Assay (Assay 64)

This assay shows that certain polypeptides of the invention stimulate an immune response and induce inflammation by inducing mononuclear cell, eosinophil and PMN infiltration at the site of injection of the animal. Compounds which stimulate an immune response are useful therapeutically where stimulation of an immune response is beneficial. This skin vascular permeability assay is conducted as follows. Hairless guinea pigs weighing 350 grams or more are anesthetized with ketamine (75–80 mg/Kg) and 5 mg/Kg xylazine intramuscularly (IM). A sample of purified polypeptide of the invention or a conditioned media test sample is injected intradermally onto the backs of the test animals with 100 μl per injection site. It is possible to have about 10–30, preferably about 16–24, injection sites per animal. One μl of Evans blue dye (1% in physiologic buffered saline) is injected intracardially. Blemishes at the injection sites are then measured (mm diameter) at 1 hr and 6 hr post injection. Animals were sacrificed at 6 hrs after injection. Each skin injection site is biopsied and fixed in formalin. The skins are then prepared for histopathologic evaluation. Each site is evaluated for inflammatory cell infiltration into the skin. Sites with visible inflammatory cell inflammation are scored as positive. Inflammatory cells may be neutrophilic, eosinophilic, monocytic or lymphocytic. At least a minimal perivascular infiltrate at the injection site is scored as positve, no infiltrate at the site of injection is scored as negative.

The following polypeptide tested positive in this assay: PRO1007, PRO1358 and PRO1375.

Example 166

Induction of Endothelial Cell Apoptosis (ELISA) (Assay 109)

The ability of PRO polypeptides to induce apoptosis in endothelial cells was tested in human venous umbilical vein endothelial cells (HUVEC, Cell Systems) using a 96-well format, in 0% serum media supplemented with 100 ng/ml VEGF, 0.1% BSA, 1× penn/strep. A positive result in this assay indicates the usefulness of the polypeptide for therapeutically treating any of a variety of conditions associated with undesired endothelial cell growth including, for example, the inhibition of tumor growth. The 96-well plates used were manufactured by Falcon (No. 3072). Coating of 96 well plates were prepared by allowing gelatinization to occur for >30 minutes with 100 μl of 0.2% gelatin in PBS solution. The gelatin mix was aspirated thoroughly before plating HUVEC cells at a final concentration of $2 \times 10^4$ cells/ml in 10% serum containing medium—100 μl volume per well. The cells were grown for 24 hours before adding test samples containing the PRO polypeptide of interest.

To all wells, 100 μl of 0% serum media (Cell Systems) complemented with 100 ng/ml VEGF, 0.1% BSA, 1× penn/strep was added. Test samples containing PRO polypeptides were added in triplicate at dilutions of 1%, 0.33% and 0.11%. Wells without cells were used as a blank and wells with cells only were used as a negative control. As a positive control, 1:3 serial dilutions of 50 μl of a 3× stock of staurosporine were used. The cells were incubated for 24 to 35 hours prior to ELISA.

ELISA was used to determine levels of apoptosis preparing solutions according to the Boehringer Manual [Boehringer, Cell Death Detection ELISA plus, Cat No. 1 920 685]. Sample preparations: 96 well plates were spun down at 1 krpm for 10 minutes (200 g); the supernatant was removed by fast inversion, placing the plate upside down on a paper towel to remove residual liquid. To each well, 200 μl of 1×Lysis buffer was added and incubation allowed at room temperature for 30 minutes without shaking. The plates were spun down for 10 minutes at 1 krpm, and 20 μl of the lysate (cytoplasmic fraction) was transferred into streptavidin coated MTP. 80 μl of immunoreagent mix was added to the 20 μl lystate in each well. The MTP was covered with adhesive foil and incubated at room tempearature for 2 hours by placing it on an orbital shaker (200 rpm). After two hours, the supernatant was removed by suction and the wells rinsed three times with 250 μl of 1× incubation buffer per well (removed by suction). Substrate solution was added (100 μl) into each well and incubated on an orbital shaker at room temperature at 250 rpm until color development was sufficient for a photometric analysis (approx. after 10–20 minutes). A 96 well reader was used to read the plates at 405 nm, reference wavelength, 492 nm. The levels obtained for PIN 32 (control buffer) was set to 100%. Samples with levels >130% were considered positive for induction of apoptosis.

The following PRO polypeptides tested positive in this assay: PRO844.

Example 167

Guinea Pig Vascular Leak (Assay 32)

This assay is designed to determine whether PRO polypeptides of the present invention show the ability to induce vascular permeability. Polypeptides testing positive in this assay are expected to be useful for the therapeutic treatment of conditions which would benefit from enhanced vascular permeability including, for example, conditions which may benefit from enhanced local immune system cell infiltration.

Hairless guinea pigs weighing 350 grams or more were anesthetized with Ketamine (75–80 mg/kg) and 5 mg/kg Xylazine intramuscularly. Test samples containing the PRO polypeptide or a physiological buffer without the test polypeptide are injected into skin on the back of the test animals with 100 μl per injection site intradermally. There were approximately 16–24 injection sites per animal. One ml of Evans blue dye (1% in PBS) is then injected intracardially. Skin vascular permeability responses to the compounds (i.e., blemishes at the injection sites of injection) are visually scored by measuring the diameter (in mm) of blue-colored leaks from the site of injection at 1, 6 and 24 hours post administration of the test materials. The mm diameter of blueness at the site of injection is observed and recorded as well as the severity of the vascular leakage. Blemishes of at least 5 mm in diameter are considered positive for the assay when testing purified proteins, being indicative of the ability to induce vascular leakage or permeability. A response greater than 7 mm diameter is considered positive for conditioned media samples. Human VEGF at 0.1 μg/100 μl is used as a positive control, inducing a response of 4–8 mm diameter.

The following PRO polypeptides tested positive in this assay: PRO1155.

Example 168

Mouse Mesengial Cell Inhibition Assay (Assay 114)

This assay is designed to determine whether PRO polypeptides of the present invention show the ability to inhibit the proliferation of mouse mesengial cells in culture. PRO polypeptides testing positive in this assay would be expected to be useful for the therapeutic treatment of such diseases or conditions where inhibition of mesengial cell proliferation would be beneficial such as, for example, cystic renal dysplasia, polycystic kidney disease, or other kidney disease associated with abnormal mesengial cell proliferation, renal tumors, and the like.

On day 1, mouse mesengial cells are plated on a 96 well plate in growth medium (a 3:1 mixture of Dulbecco's modified Eagle's medium and Ham's F12 medium, 95%; fetal bovine serum, 5%; supplemented with 14 mM HEPES) and then are allowed to grow overnight. On day 2, the PRO polypeptide is diluted at 2 different concentrations (1%, 0.1%) in serum-free medium and is added to the cells. The negative control is growth medium without added PRO polypeptide. After the cells are allowed to incubate for 48 hours, 20 μl of the Cell Titer 96 Aqueous one solution reagent (Promega) is added to each well and the colormetric reaction is allowed to proceed for 2 hours. The absorbance (OD) is then measured at 490 nm. A positive in the assay is an absorbance reading which is at least 10% above the negative control.

The following PRO polypeptides tested positive in this assay: PRO1192 and PRO1195.

Example 169

In Vitro Antitumor Assay (Assay 161)

The antiproliferative activity of various PRO polypeptides was determined in the investigational, disease-oriented in vitro anti-cancer drug discovery assay of the National Cancer Institute (NCI), using a sulforhodamine B (SRB) dye binding assay essentially as described by Skehan et al., *J. Natl. Cancer Inst.* 82:1107–1112 (1990). The 60 tumor cell lines employed in this study ("the NCI panel"), as well as conditions for their maintenance and culture in vitro have been described by Monks et al., *J. Natl. Cancer Inst.* 83:757–766 (1991). The purpose of this screen is to initially evaluate the cytotoxic and/or cytostatic activity of the test compounds against different types of tumors (Monks et al., supra; Boyd, *Cancer: Princ. Pract. Oncol. Update* 3(10):1–12 [1989]).

Cells from approximately 60 human tumor cell lines were harvested with trypsin/EDTA (Gibco), washed once, resuspended in IMEM and their viability was determined. The cell suspensions were added by pipet (100 μL volume) into separate 96-well microtiter plates. The cell density for the 6-day incubation was less than for the 2-day incubation to prevent overgrowth. Inoculates were allowed a preincubation period of 24 hours at 37° C. for stabilization. Dilutions at twice the intended test concentration were added at time zero in 100 L aliquots to the microtiter plate wells (1:2 dilution). Test compounds were evaluated at five half-log dilutions (1000 to 100,000-fold). Incubations took place for two days and six days in a 5% $CO_2$ atmosphere and 100% humidity.

After incubation, the medium was removed and the cells were fixed in 0.1 ml of 10% trichloroacetic acid at 40° C. The plates were rinsed five times with deionized water, dried, stained for 30 minutes with 0.1 ml of 0.4% sulforhodamine B dye (Sigma) dissolved in 1% acetic acid, rinsed four times with 1% acetic acid to remove unbound dye, dried, and the stain was extracted for five minutes with 0.1 ml of 10 mM Tris base [tris(hydroxymethyl)aminomethane], pH 10.5. The absorbance (OD) of sulforhodamine B at 492 nm was measured using a computer-interfaced, 96-well microtiter plate reader.

A test sample is considered positive if it shows at least 50% growth inhibitory effect at one or more concentrations. The results are shown in the following table, where the abbreviations are as follows:
NSCL=non-small cell lung carcinoma
CNS=central nervous system

TABLE 7

| Test compound | Concentration | Days | Tumor Cell Line Type | Cell Line Designation |
|---|---|---|---|---|
| PRO1016 | 0.1 nM | 2 | Leukemia | K-568 |
| PRO1016 | 0.1 nM | 2 | Leukemia | MOLT-4 |
| PRO1016 | 0.1 nM | 2 | Leukemia | RPMI-8226 |
| PRO1016 | 0.1 nM | 2 | NSCL | A549/ATCC |
| PRO1016 | 0.1 nM | 2 | NSCL | EKVX |
| PRO1016 | 0.1 nM | 2 | NSCL | NCI-H23 |
| PRO1016 | 0.1 nM | 2 | NSCL | NCI-H522 |
| PRO1016 | 0.1 nM | 2 | Colon | KM-12 |
| PRO1016 | 0.1 nM | 2 | CNS | SF-295 |
| PRO1016 | 0.1 nM | 2 | Melanoma | SK-MEL-5 |
| PRO1016 | 0.1 nM | 2 | Melanoma | UACC-257 |
| PRO1016 | 0.1 nM | 2 | Ovarian | OVCAR-3 |
| PRO1016 | 0.1 nM | 2 | Ovarian | OVCAR-4 |
| PRO1016 | 0.1 nM | 2 | Breast | NCI/SDR-RES |
| PRO1016 | 0.1 nM | 2 | Breast | T-47D |
| PRO1016 | 0.1 nM | 6 | Leukemia | CCRF-CEM |
| PRO1016 | 0.1 nM | 6 | Leukemia | K-562 |
| PRO1016 | 0.1 nM | 6 | Leukemia | MOLT-4 |
| PRO1016 | 0.1 nM | 6 | Leukemia | RPMI-8226 |
| PRO1016 | 0.1 nM | 6 | NSCL | A549/ATCC |
| PRO1016 | 0.1 nM | 6 | NSCL | EKVX |
| PRO1016 | 0.1 nM | 6 | NSCL | HOP-62 |
| PRO1016 | 0.1 nM | 6 | NSCL | NCI-H23 |
| PRO1016 | 0.1 nM | 6 | NSCL | NCI-H322M |
| PRO1016 | 0.1 nM | 6 | NSCL | NCI-H460 |
| PRO1016 | 0.1 nM | 6 | NSCL | NCI-H522 |
| PRO1016 | 0.1 nM | 6 | Colon | COLO 205 |
| PRO1016 | 0.1 nM | 6 | Colon | CHT-116 |
| PRO1016 | 0.1 nM | 6 | Colon | HCT-15 |
| PRO1016 | 0.1 nM | 6 | Colon | HT-29 |
| PRO1016 | 0.1 nM | 6 | Colon | SW-620 |
| PRO1016 | 0.1 nM | 6 | CNS | SF-295 |
| PRO1016 | 0.1 nM | 6 | CNS | SF-539 |
| PRO1016 | 0.1 nM | 6 | CNS | SNB-19 |
| PRO1016 | 0.1 nM | 6 | CNS | U251 |
| PRO1016 | 0.1 nM | 6 | Melanoma | LOX IMVI |
| PRO1016 | 0.1 nM | 6 | Melanoma | MALME-3M |
| PRO1016 | 0.1 nM | 6 | Melanoma | SK-MEL-28 |
| PRO1016 | 0.1 nM | 6 | Melanoma | SK-MEL-5 |
| PRO1016 | 0.1 nM | 6 | Melanoma | UACC-257 |
| PRO1016 | 0.1 nM | 6 | Melanoma | UACC-62 |
| PRO1016 | 0.1 nM | 6 | Ovarian | IGROV1 |
| PRO1016 | 0.1 nM | 6 | Ovarian | OVCAR-3 |
| PRO1016 | 0.1 nM | 6 | Ovarian | OVCAR-4 |
| PRO1016 | 0.1 nM | 6 | Ovarian | OVCAR-8 |
| PRO1016 | 0.1 nM | 6 | Renal | ACHN |
| PRO1016 | 0.1 nM | 6 | Renal | RXF 393 |
| PRO1016 | 0.1 nM | 6 | Renal | SN12C |
| PRO1016 | 0.1 nM | 6 | Renal | TK-10 |
| PRO1016 | 0.1 nM | 6 | Prostate | PC-3 |
| PRO1016 | 0.1 nM | 6 | Breast | MCF-7 |
| PRO1016 | 0.1 nM | 6 | Breast | NCI/ADR-RES |
| PRO1016 | 0.1 nM | 6 | Breast | MDA-MB-231 |
| PRO1016 | 0.1 nM | 6 | Breast | MDA-MB-435 |
| PRO1016 | 0.1 nM | 6 | Breast | MDA-N |
| PRO1016 | 0.1 nM | 6 | Breast | BT-549 |
| PRO1016 | 0.1 nM | 6 | Breast | T-47D |
| PRO1186 | 95 nM | 2 | NSCL | NCI-H226 |
| PRO1186 | 95 nM | 2 | Colon | Colo205 |
| PRO1186 | 2.2 nM | 6 | Breast | MDA-N |
| PRO1186 | 114 nM | 2 | NSCL | NCI-H322M |
| PRO1186 | 114 nM | 2 | CNS | SF-268; SF-539 |
| PRO1186 | 114 nM | 2 | Ovarian | IGFOV1 |
| PRO1186 | 114 nM | 2 | Renal | 786-0; SN12C; TK-10 |
| PRO1186 | 114 nM | 6 | Leukemia | MOLT-4; RPMI-8226 |
| PRO1186 | 114 nM | 6 | Melanoma | LOX IMVI |
| PRO1186 | 114 nM | 6 | Ovarian | OVCAR-4; SK-OV-3 |
| PRO1186 | 114 nM | 6 | Breast | MDA-MB-435; T-47D |
| PRO1186 | 8.1 nM | 6 | Leukemia | K-562 |
| PRO1186 | 8.1 nM | 6 | NSCL | HOP-62 |
| PRO1186 | 8.1 nM | 6 | Colon | Colo205; HCC-2998 |
| PRO1186 | 8.1 nM | 6 | Breast | T-47D |

TABLE 7-continued

| Test compound | Concentration | Days | Tumor Cell Line Type | Cell Line Designation |
|---|---|---|---|---|
| PRO1186 | 15.4 nM | 6 | Leukemia | K-562 |
| PRO1186 | 3.6 nM | 2 | Ovarian | OVCAR-3 |
| PRO1186 | 3.6 nM | 6 | NSCL | HOP-62 |

The results of these assays demonstrate that the positive testing PRO polypeptides are useful for inhibiting neoplastic growth in a number of different tumor cell types and may be used therapeutically therefor. Antibodies against these PRO polypeptides are useful for affinity purification of these useful polypeptides. Nucleic acids encoding these PRO polypeptides are useful for the recombinant preparation of these polypeptides.

Example 170

Gene Amplification in Tumors

This example shows that certain PRO polypeptide-encoding genes are amplified in the genome of certain human lung, colon and/or breast cancers and/or cell lines. Amplification is associated with overexpression of the gene product, indicating that the polypeptides are useful targets for therapeutic intervention in certain cancers such as colon, lung, breast and other cancers and diagnostic determination of the presence of those cancers. Therapeutic agents may take the form of antagonists of the PRO polypeptide, for example, murine-human chimeric, humanized or human antibodies against a PRO polypeptide.

The starting material for the screen was genomic DNA isolated from a variety cancers. The DNA is quantitated precisely, e.g., fluorometrically. As a negative control, DNA was isolated from the cells of ten normal healthy individuals which was pooled and used as assay controls for the gene copy in healthy individuals (not shown). The 5' nuclease assay (for example, TaqMan™) and real-time quantitative PCR (for example, ABI Prizm 7700 Sequence Detection System™ (Perkin Elmer, Applied Biosystems Division, Foster City, Calif.)), were used to find genes potentially amplified in certain cancers. The results were used to determine whether the DNA encoding the PRO polypeptide is over-represented in any of the primary lung or colon cancers or cancer cell lines or breast cancer cell lines that were screened. The primary lung cancers were obtained from individuals with tumors of the type and stage as indicated in Table 8. An explanation of the abbreviations used for the designation of the primary tumors listed in Table 8 and the primary tumors and cell lines referred to throughout this example are given below.

The results of the TaqMan™ are reported in delta (Δ) Ct units. One unit corresponds to 1 PCR cycle or approximately a 2-fold amplification relative to normal, two units corresponds to 4-fold, 3 units to 8-fold amplification and so on. Quantitation was obtained using primers and a TaqMan™ fluorescent probe derived from the PRO polypeptide-encoding gene. Regions of the PRO polypeptide-encoding gene which are most likely to contain unique nucleic acid sequences and which are least likely to have spliced out introns are preferred for the primer and probe derivation, e.g., 3'-untranslated regions. The sequences for the primers and probes (forward, reverse and probe) used for the PRO polypeptide gene amplification analysis were as follows:

```
PRO290 (DNA35680-1212):
35680.tm.p:
5'-CCACCAATGGCAGCCCCACCT-3'                      (SEQ ID NO:428)
35680.tm.f:
5'-GACTGCCCTCCCTGCCA-3'                          (SEQ ID NO:429)
35680.tm.r:
5'CAAAAAGCCTGGAAGTCTTCAAAG-3'                    (SEQ ID NO:430)

PRO341 (DNA26288-1239):
26288.tm.f1:
5'-CAGCTGGACTGCAGGTGCTA-3'                       (SEQ ID NO:431)
26288.tm.r1:
5'-CAGTGAGCACAGCAAGTGTCCT-3'                     (SEQ ID NO:432)
26288.tm.p1:
5'-GGCCACCTCCTTGAGTCTTCAGTTCCCT-3'               (SEQ ID NO:433)

PRO535 (DNA49143-1429):
49143.tm.f1:
5'-CAACTACTGGCTAAAGCTGGTGAA-3'                   (SEQ ID NO:434)
49143.tm.r1:
5'-CCTTTCTGTATAGGTGATACCCAATGA-3'                (SEQ ID NO:435)
49143.tm.p1:
5'-TGGCCATCCCTACCAGAGGCAAAA-3'                   (SEQ ID NO:436)

PRO619 (DNA49821-1562):
49821.tm.f1:
5'-CTGAAGACGACGCGGATTACTA-3'                     (SEQ ID NO:437)
49821.tm.r1:
5'-GGCAGAAATGGGAGGCAGA-3'                        (SEQ ID NO:438)
49821.tm.p1:
5'-TGCTCTGTTGGCTACGGCTTTAGTCCCTAG-3'             (SEQ ID NO:439)
```

-continued

```
PRO809 (DNA57836-1338):
57836.tm.f1:
5'-AGCAGCAGCCATGTAGAATGAA-3'                           (SEQ ID NO:440)
57836.tm.r1:
5'-AATACGAACAGTGCACGCTGAT-3'                           (SEQ ID NO:441)
57836.tm.p1:
5'-TCCAGAGAGCCAAGCACGGCAGA-3'                          (SEQ ID NO:442)

PRO830 (DNA56866-1342):
56866.tm.f1:
5'-TCTAGCCAGCTTGGCTCCAATA-3'                           (SEQ ID NO:443)
56866.tm.r1:
5'-CCTGGCTCTAGCACCAACTCATA-3'                          (SEQ ID NO:444)
56866.tm.p1:
5'-TCAGTGGCCCTAAGGAGATGGGCCT-3'                        (SEQ ID NO:445)

PRO848 (DNA59839-1461):
59839.tm.f1:
5'-CAGGATACAGTGGGAATCTTGAGA-3'                         (SEQ ID NO:446)
59839.tm.p1:
5'-CCTGAAGGGCTTGGAGCTTAGT-3'                           (SEQ ID NO:447)
59839.tm.p1:
5'-TCTTTGGCCATTTCCCATGGCTCA-3'                         (SEQ ID NO:448)

PRO943 (DNA52192-1369):
52192.tm.f1:
5'-CCCATGGCGAGGAGGAAT-3'                               (SEQ ID NQ:449)
52192.tm.r1:
5'-TGCGTACGTGTGCCTTCAG-3'                              (SEQ ID NO:450)
52192.tm.p1:
5'-CAGCACCCCAGGCAGTCTGTGT-3'                           (SEQ ID NO:451)

PRO1005 (DNA57708-1411):
57708.tm.f1:
5'-AACGTGCTACACGACCAGTGTACT-3'                         (SEQ ID NO:452)
57708.tm.r1:
5'-CACAGCATATTCAGATGACTAAATCCA-3'                      (SEQ ID NO:453)
57708.tm.p1:
5'-TTGTTTAGTTCTCCACCGTGTCTCCACAGAA-3'                  (SEQ ID NO:454)

PRO1009 (DNA57129-1413):
57129.tm.f1:
5'-TGTCAGAATGCAACCTGGCTT-3'                            (SEQ ID NO:455)
57129.tm.r1:
5'-TGATGTGCCTGGCTCAGAAC-3'                             (SEQ ID NO:456)
57129.tm.p1:
5'-TGCACCTAGATGTCCCCAGCACCC-3'                         (SEQ ID NO:457)

PRO1097 (DNA59841-1460):
59841.tm.f1:
5'-AAGATGCGCCAGGCTTCTTA-3'                             (SEQ ID NO:458)
59841.tm.r1:
5'-CTCCTGTACGGTCTGCTCACTTAT-3'                         (SEQ ID NO:459)
59841.tm.p1:
5'-TGGCTGTCAGTCCAGTGTGCATGG-3'                         (SEQ ID NO:460)

PRO1107 (DNA59606-1471):
59606.tm.f1:
5'-GCATAGGGATAGATAAGATCCTGCTTTAT-3'                    (SEQ ID NO:461)
59606.tm.r1:
5'-CAAATTAAAGTACCCATCAGGAGAGAA-3'                      (SEQ ID NO:462)
59606.tm.p1:
5'-AAGTTGCTAAATATATACATTATCTGCGCCAAGTCCA-3'            (SEQ ID NO:463)

PRO1111 (DNA58721-1475):
58721.tm.f1:
5'-GTGCTGCCCACAATTCATGA-3'                             (SEQ ID NO:464)
58721.tm.r1:
5'-GTCCTTGGTATGGGTCTGAATTATAT-3'                       (SEQ ID NO:465
58721.tm.p1:
5'-ACTCTCTGCACCCCACAGTCACCACTATCTC-3'                  (SEQ ID NO:466)

PRO1153 (DNA59842-1502):
59842.tm.f1:
5'-CTGAGGAACCAGCCATGTCTCT-3'                           (SEQ ID NO:467)
59842.tm.r1:
5'-GACCAGATGCAGGTACAGGATGA-3'                          (SEQ ID NO:468)
59842.tm.p1:
5'-CTGCCCCTTCAGTGATGCCAACCTT-3'                        (SEQ ID NO:469)
```

-continued

```
PRO1182 (DNA59848-1512):
59848.tm.f1:
5'-GGGTGGAGGCTCACTGAGTAGA-3'             (SEQ ID NO:470)
59848.tm.r1:
5'-CAATACAGGTAATGAAACTCTGCTTCTT-3'       (SEQ ID NQ:471)
59848.tm.p1:
5'-TCCTCTTAAGCATAGGCCATTTTCTCAGTTTAGACA-3'  (SEQ ID NO:472)

PRO1184 (DNA59220-1514):
59220.tm.f1:
5'-GGTGGTCTTGCTTGGTCTCAC-3'              (SEQ ID NO:473)
59220.tm.r1:
5'-CCGTCGTTCAGCAACATGAC-3'               (SEQ ID NO:474)
59220.tm.p1:
5'-ACCGCCTACCGCTGTGCCCA-3'               (SEQ ID NO:475)

PRO1187 (DNA62876-1517):
62876.tm.f1:
5'-CAGTAAAACCACAGGCTGGATTT-3'            (SEQ ID NO:476)
62876.tm.r1:
5'-CCTGAGAGCAAGAAGGTTGAGAAT-3'           (SEQ ID NO:477)
62876.tm.p1:
5'-TAGACAGGGACCATGGCCCGCA-3'             (SEQ ID NO:478)

PRO1281 (DNA59820-1549):
59820.tm.f1:
5'-TGGGCTGTAGAAGAGTTGTTG-3'              (SEQ ID NO:479)
59820.tm.r1:
5'-TCCACACTTGGCCAGTTTAT-3'               (SEQ ID NO:480)
59820.tm.p1:
5'-CCCAACTTCTCCCTTTTGGACCCT-3'           (SEQ ID NO:481)

PRO1112 (DNA57702-1476):
57702.tm.f1
5'-GTCCCTTCACTGTTTAGAGCATGA-3'           (SEQ ID NO:482)
57702.tm.p1
5'-ACTCTCCCCCTCAACAGCCTCCTGAG-3'         (SEQ ID NO:483)
57702.tm.r1
5'-GTGGTCAGGGCAGATCCTTT-3'               (SEQ ID NO:484)

PRO1185 (DNA62881-1515):
62881.tm.f1:
5'-ACAGATCCAGGAGAGACTCCACA-3'            (SEQ ID NO:485)
62881.tm.p1:
5'-AGCGGCGCTCCCAGCCTGAAT-3'              (SEQ ID NO:486)
62881.tm.r1:
5'-CATGATTGGTCCTCAGTTCCATC-3'            (SEQ ID NO:487)

PRO1245 (DNA64884-1527):
64884.tm.f1:
5'-ATAGAGGGCTCCCAGAAGTG-3'               (SEQ ID NO:488)
64884.tm.p1:
5'-CAGGGCCTTCAGGGCCTTCAC-3'              (SEQ ID NO:489)
64884.tm.r1:
5'-GCTCAGCCAAACACTGTCA-3'                (SEQ ID NO:490)
64884.tm.f2:
5'-GGGGCCCTGACAGTGTT-3'                  (SEQ ID NO:491)
64884.tm.p2:
5'-CTGAGCCGAGACTGGAGCATCTACAC-3'         (SEQ ID NQ:492)
64884.tm.r2:
5'-GTGGGCAGCGTCTTGTC-3'                  (SEQ ID NO:493)
```

The 5' nuclease assay reaction is a fluorescent PCR-based technique which makes use of the 5' exonuclease activity of Taq DNA polymerase enzyme to monitor amplification in real time. Two oligonucleotide primers (forward [.f] and reverse [.r]) are used to generate an amplicon typical of a PCR reaction. A third oligonucleotide, or probe (.p), is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

The 5' nuclease procedure is run on a real-time quantitative PCR device such as the ABI Prism 7700™ Sequence Detection. The system consists of a thermocycler, laser, charge-coupled device (CCD) camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

5' Nuclease assay data are initially expressed as Ct, or the threshold cycle. This is defined as the cycle at which the reporter signal accumulates above the background level of fluorescence. The ΔCt values are used as quantitative measurement of the relative number of starting copies of a particular target sequence in a nucleic acid sample when comparing cancer DNA results to normal human DNA results.

Table 8 describes the stage, T stage and N stage of various primary tumors which were used to screen the PRO polypeptide compounds of the invention.

20 mg/ml and equilibrated at 4° C. 10 ml of G2 Buffer was prepared by diluting Qiagen RNAse A stock (100 mg/ml) to a final concentration of 200 μg/ml.

Buffer C1 (10 ml, 4° C.) and ddH$_2$O (40 ml, 4° C.) were then added to the 10 ml of cell suspension, mixed by inverting and incubated on ice for 10 minutes. The cell nuclei were pelleted by centrifuging in a Beckman swinging bucket rotor at 2500 rpm at 4° C. for 15 minutes. The supernatant was discarded and the nuclei were suspended with a vortex into 2 ml Buffer C1 (at 4° C.) and 6 ml ddH$_2$O, followed by a second 4° C. centrifugation at 2500 rpm for 15 minutes. The nuclei were then resuspended into the residual buffer using 200 μl per tip. G2 buffer (10 ml) was added to the suspended nuclei while gentle vortexing was applied. Upon completion of buffer addition, vigorous vor-

TABLE 8

Primary Lung and Colon Tumor Profiles

| Primary Tumor Stage | Stage | Other Stage | Dukes Stage | T Stage | N Stage |
|---|---|---|---|---|---|
| Human lung tumor AdenoCa (SRCC724) [LT1] | IIA | | | T1 | N1 |
| Human lung tumor SqCCa (SRCC725) [LT1a] | IIB | | | T3 | N0 |
| Human lung tumor AdenoCa (SRCC726) [LT2] | IB | | | T2 | N0 |
| Human lung tumor AdenoCa (SRCC727) [LT3] | IIIA | | | T1 | N2 |
| Human lung tumor AdenoCa (SRCC728) [LT4] | IB | | | T2 | N0 |
| Human lung tumor SqCCa (SRCC729) [LT6] | IB | | | T2 | N0 |
| Human lung tumor Aden/SqCCa (SRCC730) [LT7] | IA | | | T1 | N0 |
| Human lung tumor AdenoCa (SRCC731) [LT9] | IB | | | T2 | N0 |
| Human lung tumor SqCCa (SRCC732) [LT10] | IIB | | | T2 | N1 |
| Human lung tumor SqCCa (SRCC733) [LT11] | IIA | | | T1 | N1 |
| Human lung tumor AdenoCa (SRCC734) [LT12] | IV | | | T2 | N0 |
| Human lung tumor AdenoSqCCa (SRCC735)[LT13] | IB | | | T2 | N0 |
| Human lung tumor SqCCa (SRCC736) [LT15] | IB | | | T2 | N0 |
| Human lung tumor SqCCa (SRCC737) [LT16] | IB | | | T2 | N0 |
| Human lung tumor SqCCa (SRCC738) [LT17] | IIB | | | T2 | N1 |
| Human lung tumor SqCCa (SRCC739) [LT18] | IB | | | T2 | N0 |
| Human lung tumor SqCCa (SRCC740) [LT19] | IB | | | T2 | N0 |
| Human lung tumor LCCa (SRCC741) [LT21] | IIB | | | T3 | N1 |
| Human lung AdenoCa (SRCC811) [LT22] | 1A | | | T1 | N0 |
| Human colon AdenoCa (SRCC742) [CT2] | | M1 | D | pT4 | N0 |
| Human colon AdenoCa (SRCC743) [CT3] | | | B | pT3 | N0 |
| Human colon AdenoCa (SRCC744) [CT8] | | | B | T3 | N0 |
| Human colon AdenoCa (SRCC745) [CT10] | | | A | pT2 | N0 |
| Human colon AdenoCa (SRCC746) [CT12] | | MO, R1 | B | T3 | N0 |
| Human colon AdenoCa (SRCC747) [CT14] | | pMO, RO | B | pT3 | pN0 |
| Human colon AdenoCa (SRCC748) [CT15] | | M1, R2 | D | T4 | N2 |
| Human colon AdenoCa (SRCC749) [CT16] | | pMO | B | pT3 | pN0 |
| Human colon AdenoCa (SRCC750) [CT17] | | | C1 | pT3 | pN1 |
| Human colon AdenoCa (SRCC751) [CT1] | | MO, R1 | B | pT3 | N0 |
| Human colon AdenoCa (SRCC752) [CT4] | | | B | pT3 | M0 |
| Human colon AdenoCa (SRCC753) [CT5] | | G2 | C1 | pT3 | pN0 |
| Human colon AdenoCa (SRCC754) [CT6] | | pMO, RO | B | pT3 | pN0 |
| Human colon AdenoCa (SRCC755) [CT7] | | G1 | A | pT2 | pN0 |
| Human colon AdenoCa (SRCC756) [CT9] | | G3 | D | pT4 | pN2 |
| Human colon AdenoCa (SRCC757) [CT11] | | | B | T3 | N0 |
| Human colon AdenoCa (SRCC758) [CT18] | | MO, RO | B | pT3 | pN0 |

DNA Preparation:

DNA was prepared from cultured cell lines, primary tumors, normal human blood. The isolation was performed using purification kit, buffer set and protease and all from Quiagen, according to the manufacturer's instructions and the description below.

Cell Culture Lysis:

Cells were washed and trypsinized at a concentration of $7.5 \times 10^8$ per tip and pelleted by centrifuging at 1000 rpm for 5 minutes at 4° C., followed by washing again with 1/2 volume of PBS recentrifugation. The pellets were washed a third time, the suspended cells collected and washed 2× with PBS. The cells were then suspended into 10 ml PBS. Buffer C1 was equilibrated at 4° C. Qiagen protease #19155 was diluted into 6.25 ml cold ddH$_2$O to a final concentration of texing was applied for 30 seconds. Quiagen protease (200 μl, prepared as indicated above) was added and incubated at 50° C. for 60 minutes. The incubation and centrifugation was repeated until the lysates were clear (e.g., incubating additional 30–60 minutes, pelleting at 3000×g for 10 min., 4° C.).

Solid Human Tumor Sample Preparation and Lysis:

Tumor samples were weighed and placed into 50 ml conical tubes and held on ice. Processing was limited to no more than 250 mg tissue per preparation (1 tip/preparation). The protease solution was freshly prepared by diluting into 6.25 ml cold ddH$_2$O to a final concentration of 20 mg/ml and stored at 4° C. G2 buffer (20 ml) was prepared by diluting DNAse A to a final concentration of 200 mg/ml (from 100 mg/ml stock). The tumor tissue was homogenized in 19 ml G2 buffer for 60 seconds using the large tip of the polytron in a laminar-flow TC hood in order to avoid inhalation of aerosols, and held at room temperature. Between samples, the polytron was cleaned by spinning at 2×30 seconds each in 2L ddH$_2$O, followed by G2 buffer (50 ml). If tissue was still present on the generator tip, the apparatus was disassembled and cleaned.

Quiagen protease (prepared as indicated above, 1.0 ml) was added, followed by vortexing and incubation at 50° C. for 3 hours. The incubation and centrifugation was repeated until the lysates were clear (e.g., incubating additional 30–60 minutes, pelleting at 3000×g for 10 min., 4° C.).

Human Blood Preparation and Lysis:

Blood was drawn from healthy volunteers using standard infectious agent protocols and citrated into 10 ml samples per tip. Quiagen protease was freshly prepared by dilution into 6.25 ml cold ddH$_2$O to a final concentration of 20 mg/ml and stored at 4° C. G2 buffer was prepared by diluting RNAse A to a final concentration of 200 µg/ml from 100 mg/ml stock. The blood (10 ml) was placed into a 50 ml conical tube and 10 ml C1 buffer and 30 ml ddH$_2$O (both previously equilibrated to 4° C.) were added, and the components mixed by inverting and held on ice for 10 minutes. The nuclei were pelleted with a Beckman swinging bucket rotor at 2500 rpm, 4° C. for 15 minutes and the supernatant discarded. With a vortex, the nuclei were suspended into 2 ml C1 buffer (4° C.) and 6 ml ddH$_2$O (4° C.). Vortexing was repeated until the pellet was white. The nuclei were then suspended into the residual buffer using a 200 µl tip. G2 buffer (10 ml) were added to the suspended nuclei while gently vortexing, followed by vigorous vortexing for 30 seconds. Quiagen protease was added (200 µl) and incubated at 50° C. for 60 minutes. The incubation and centrifugation was repeated until the lysates were clear (e.g., incubating additional 30–60 minutes, pelleting at 3000×g for 10 min., 4° C.).

Purification of Cleared Lysates:

(1) Isolation of Genomic DNA:

Genomic DNA was equilibrated (1 sample per maxi tip preparation) with 10 ml QBT buffer. QF elution buffer was equilibrated at 50° C. The samples were vortexed for 30 seconds, then loaded onto equilibrated tips and drained by gravity. The tips were washed with 2×15 ml QC buffer. The DNA was eluted into 30 ml silanized, autoclaved 30 ml Corex tubes with 15 ml QF buffer (50° C.). Isopropanol (10.5 ml) was added to each sample, the tubes covered with parafin and mixed by repeated inversion until the DNA precipitated. Samples were pelleted by centrifugation in the SS-34 rotor at 15,000 rpm for 10 minutes at 4° C. The pellet location was marked, the supernatant discarded, and 10 ml 70% ethanol (4° C.) was added. Samples were pelleted again by centrifugation on the SS-34 rotor at 10,000 rpm for 10 minutes at 4° C. The pellet location was marked and the supernatant discarded. The tubes were then placed on their side in a drying rack and dried 10 minutes at 37° C., taking care not to overdry the samples.

After drying, the pellets were dissolved into 1.0 ml TE (pH 8.5) and placed at 50° C. for 1–2 hours. Samples were held overnight at 4° C. as dissolution continued. The DNA solution was then transferred to 1.5 ml tubes with a 26 gauge needle on a tuberculin syringe. The transfer was repeated 5× in order to shear the DNA. Samples were then placed at 50° C. for 1–2 hours.

(2) Quantitation of Genomic DNA and Preparation for Gene Amplification Assay:

The DNA levels in each tube were quantified by standard $A_{260}$, $A_{280}$ spectrophotometry on a 1:20 dilution (5 µl DNA+95 µl ddH$_2$O) using the 0.1 ml quartz cuvetts in the Beckman DU640 spectrophotometer. $A_{260}/A_{280}$ ratios were in the range of 1.8–1.9. Each DNA samples was then diluted further to approximately 200 ng/ml in TE (pH 8.5). If the original material was highly concentrated (about 700 ng/µl), the material was placed at 50° C. for several hours until resuspended. Fluorometric DNA quantitation was then performed on the diluted material (20–600 ng/ml) using the manufacturer's guidelines as modified below. This was accomplished by allowing a Hoeffer DyNA Quant 200 fluorometer to warm-up for about 15 minutes. The Hoechst dye working solution (#H33258, 10 µl, prepared within 12 hours of use) was diluted into 100 ml 1×TNE buffer. A 2 ml cuvette was filled with the fluorometer solution, placed into the machine, and the machine was zeroed. pGEM 3Zf(+) (2 µl, lot #360851026) was added to 2 ml of fluorometer solution and calibrated at 200 units. An additional 2 µl of pGEM 3Zf(+) DNA was then tested and the reading confirmed at 400+/−10 units. Each sample was then read at least in triplicate. When 3 samples were found to be within 10% of each other, their average was taken and this value was used as the quantification value.

The fluorometricly determined concentration was then used to dilute each sample to 10 ng/µl in ddH$_2$O. This was done simultaneously on all template samples for a single TaqMan plate assay, and with enough material to run 500–1000 assays. The samples were tested in triplicate with Taqman™ primers and probe both B-actin and GAPDH on a single plate with normal human DNA and no-template controls. The diluted samples were used provided that the CT value of normal human DNA subtracted from test DNA was +/−1 Ct. The diluted, lot-qualified genomic DNA was stored in 1.0 ml aliquots at −80° C. Aliquots which were subsequently to be used in the gene amplification assay were stored at 4° C. Each 1 ml aliquot is enough for 8–9 plates or 64 tests.

Gene Amplification Assay:

The PRO polypeptide compounds of the invention were screened in the following primary tumors and the resulting ΔCt values greater than or equal to 1.0 are reported in Tables 9A-C below.

TABLE 9A

ΔCt values in lung and colon primary tumors and cell line models

| Primary Tumor | PRO290 | PRO341 | PRO535 | PRO619 | PRO1112 | PRO809 | PRO830 | PRO848 |
|---|---|---|---|---|---|---|---|---|
| LT-1a | — | — | — | — | — | — | 1.13 | — |
| LT3 | — | — | — | 1.04 | — | — | — | — |
|  |  |  |  | 1.68 |  |  |  |  |
| LT7 | — | — | — | 1.21 | — | — | — | — |
|  |  |  |  | 1.34 |  |  |  |  |

TABLE 9A-continued

ΔCt values in lung and colon primary tumors and cell line models

| Primary Tumor | PRO290 | PRO341 | PRO535 | PRO619 | PRO1112 | PRO809 | PRO830 | PRO848 |
|---|---|---|---|---|---|---|---|---|
| LT9 | — | — | — | 1.19 1.34 | — | — | — | — |
| LT10 | — | — | — | 1.41 2.02 | 1.135 | — | — | — |
| LT11 | 1.63 | — | 1.40 | 1.69 1.57 | 1.525 | 1.40 | 1.25 | 1.04 |
| LT12 | — | — | — | 1.81 | 1.195 | 1.61 | 1.35 | 1.22 |
| LT13 | 1.47 | — | 1.37 | 2.13 1.74 | 1.635 | 1.03 | — | — |
| LT15 | 1.67 | — | — | 2.08 1.52 | 1.775 | — | — | — |
| LT16 | — | 1.12 | — | — | — | — | — | — |
| LT17 | 1.22 | 1.33 | 1.42 | 1.83 1.67 | 1.455 | 1.10 | 1.17 | — |
| LT18 | — | — | — | 1.32 1.14 | 1.255 | — | — | — |
| LT19 | 2.07 | — | — | 2.33 1.90 | — | — | 1.31 | — |
| LT21 | — | 1.15 | — | 1.15 1.09 | — | 1.05 | — | 1.07 |
| CT2 | 1.56 | — | — | 1.22 | 2.265 | — | — | — |
| CT3 | — | — | 1.28 | 1.49 | — | — | — | — |
| CT8 | — | — | — | — | 1.065 | — | — | — |
| CT10 | — | — | 1.34 | — | 1.575 | — | — | — |
| CT12 | — | — | — | — | 1.315 | — | — | — |
| CT14 | — | — | 1.29 | — | 1.895 | — | — | — |
| CT15 | — | — | 1.10 | 1.00 | 1.465 | — | — | — |
| CT16 | — | — | 1.35 | 1.02 | 1.255 | — | — | — |
| CT17 | — | — | 1.26 | 1.23 | — | — | — | — |
| CT1 | — | — | — | 1.12 | 1.245 | — | — | — |
| CT4 | — | — | 1.03 | 1.25 | 1.535 | — | — | — |
| CT5 | — | — | — | 1.34 | 1.975 | — | — | — |
| CT6 | — | — | 1.00 | 1.06 | 1.575 | — | — | — |
| CT11 | 1.16 | — | 1.25 | 1.80 | 2.285 | — | — | — |

TABLE 9B

ΔCt values in lung and colon primary tumors and cell line models

| Primary Tumor | PRO943 | PRO1005 | PRO1009 | PRO1185 | PRO1245 | PRO1097 | PRO11O7 | PRO1111 | PRO1153 |
|---|---|---|---|---|---|---|---|---|---|
| LT-1 | — | 1.07 | — | — | — | — | — | — | — |
| LT-1a | — | 3.87 | — | — | — | — | — | — | — |
| LT2 | — | — | — | — | — | 1.23 | — | — | — |
| LT3 | — | 1.61 | — | 1.01 | — | — | — | 1.39 | — |
| LT4 | — | — | — | — | — | — | — | 1.49 | 1.01 |
| LT6 | — | 1.29 | — | — | — | — | — | — | — |
| LT7 | — | — | — | — | — | — | — | 1.58 | 1.52 |
| LT9 | — | 2.50 | — | — | — | 1.21 | — | 1.44 | — |
| LT10 | — | — | — | — | — | — | — | 1.05 | — |
| LT11 | 2.06 | — | — | — | — | — | — | 1.45 | — |
| LT12 | 1.94 | 1.21 | — | — | — | — | — | — | — |
| LT13 | 1.64 1.27 | 2.30 | — | — | 3.84 | — | 3.55 | — | — |
| LT15 | 2.05 | 1.03 | — | — | 1.01 | — | 2.47 | — | — |
| LT16 | — | 1.05 | — | — | 1.98 | — | 2.45 | — | — |
| LT17 | 1.93 | — | — | — | — | — | — | 1.47 | — |
| LT19 | 2.90 | — | — | — | — | — | — | — | — |
| LT26 | — | — | — | 1.66 | — | — | — | — | — |
| LT30 | — | — | — | 1.58 | — | — | — | — | — |
| CT2 | 1.92 1.70 | — | 2.00 | 1.73 | — | — | 4.75 | — | — |
| CT3 | — | — | 1.75 | — | — | — | 1.52 | — | — |
| CT8 | 1.37 1.12 | — | 1.29 | — | — | — | — | — | — |
| CT10 | 2.13 1.67 | — | 1.73 | — | — | — | 2.82 | — | — |
| CT12 | 1.43 | — | 1.92 | — | — | — | — | — | — |
| CT14 | 1.46 | — | 2.10 | — | — | 1.08 | 1.54 | 1.38 | — |
| CT15 | — | — | 2.02 | — | 1.00 | — | — | — | — |

TABLE 9B-continued

ΔCt values in lung and colon primary tumors and cell line models

| Primary Tumor | PRO943 | PRO1005 | PRO1009 | PRO1185 | PRO1245 | PRO1097 | PRO1107 | PRO1111 | PRO1153 |
|---|---|---|---|---|---|---|---|---|---|
| CT16 | — | — | 1.56 | — | — | 1.11 | — | — | — |
| CT17 | 1.30 | — | 1.76 | — | — | 1.34 | — | — | — |
| CT1 | 1.36 | — | — | — | — | — | 1.57 | — | — |
| CT4 | — | — | 1.06 | — | — | — | 1.59 | — | — |
| CT5 | 1.88 | — | 1.43 | — | — | — | — | — | — |
|  | 2.51 |  |  |  |  |  |  |  |  |
| CT6 | 1.41 | — | — | — | — | — | — | — | — |
|  | 1.75 |  |  |  |  |  |  |  |  |
| CT7 | — | — | — | — | — | — | — | 1.16 | — |
| CT11 | 2.80 | — | 1.83 | — | — | — | — | 1.17 | — |
|  | 2.61 |  |  |  |  |  |  |  |  |
| CT18 | 1.30 | — | — | — | — | — | — | 1.05 | — |
| H522 | — | — | — | — | 1.10 | — | — | — | — |

TABLE 9C

ΔCt values in lung and colon primary tumors and cell line models

| Primary Tumor | PRO1182 | PRO1184 | PRO1187 | PRO1281 |
|---|---|---|---|---|
| LT-1 | 1.81 | — | — | — |
| LT-1a | — | 1.14 | — | — |
|  |  | 1.09 |  |  |
| LT4 | 1.43 | 1.37 | — | — |
|  |  | 1.18 |  |  |
| LT6 | — | 1.78 | — | — |
|  |  | 1.66 |  |  |
|  |  | 1.05 |  |  |
| LT9 | 1.43 | — | — | — |
| LT12 | — | 2.47 | 1.17 | — |
|  |  | 2.61 |  |  |
|  |  | 1.80 |  |  |
| LT15 | — | — | 1.55 | — |
| LT16 | — | 1.01 | 1.33 | — |
| LT17 | — | — | — | — |
| LT18 | — | 1.07 | — | — |
|  |  | 1.13 |  |  |
| LT19 | — | 1.19 | — | — |
|  |  | 1.35 |  |  |
|  |  | 1.02 |  |  |
| LT21 | — | 1.00 | — | — |
|  |  | 1.20 |  |  |
| CT2 | — | — | — | 1.15 |
| CT12 | — | — | — | 1.07 |

Because amplification of the various DNAs described above occurs in various cancerous tumors and tumor cell lines derived from various human tissues, these molecules likely play a significant role in tumor formation and/or growth. As a result, amplification and/or enhanced expression of these molecules can serve as a diagnostic for detecting the presence of tumor in an individual and antagonists (e.g., antibodies) directed against the proteins encoded by the above described DNA molecules would be expected to have utility in cancer therapy.

Example 171

Identification of Receptor/Ligand Interactions

In this assay, various PRO polypeptides are tested for ability to bind to a panel of potential receptor molecules for the purpose of identifying receptor/ligand interactions. The identification of a ligand for a known receptor, a receptor for a known ligand or a novel receptor/ligand pair is useful for a variety of indications including, for example, targeting bioactive molecules (linked to the ligand or receptor) to a cell known to express the receptor or ligand, use of the receptor or ligand as a reagent to detect the presence of the ligand or receptor in a composition suspected of containing the same, wherein the composition may comprise cells suspected of expressing the ligand or receptor, modulating the growth of or another biological or immunological activity of a cell known to express or respond to the receptor or ligand, modulating the immune response of cells or toward cells that express the receptor or ligand, allowing the preparaion of agonists, antagonists and/or antibodies directed against the receptor or ligand which will modulate the growth of or a biological or immunological activity of a cell expressing the receptor or ligand, and various other indications which will be readily apparent to the ordinarily skilled artisan.

The assay is performed as follows. A PRO polypeptide of the present invention suspected of being a ligand for a receptor is expressed as a fusion protein containing the Fc domain of human IgG (an immunoadhesin). Receptor-ligand binding is detected by allowing interaction of the immunoadhesin polypeptide with cells (e.g. Cos cells) expressing candidate PRO polypeptide receptors and visualization of bound immunoadhesin with fluorescent reagents directed toward the Fc fusion domain and examination by microscope. Cells expressing candidate receptors are produced by transient transfection, in parallel, of defined subsets of a library of cDNA expression vectors encoding PRO polypeptides that may function as receptor molecules. Cells are then incubated for 1 hour in the presence of the PRO polypeptide immunoadhesin being tested for possible receptor binding. The cells are then washed and fixed with paraformaldehyde. The cells are then incubated with fluorescent conjugated antibody directed against the Fc portion of the PRO polypeptide immunoadhesin (e.g. FITC conjugated goat anti-human-Fc antibody). The cells are then washed again and examined by microscope. A positive interaction is judged by the presence of fluorescent labeling of cells transfected with cDNA encoding a particular PRO polypeptide receptor or pool of receptors and an absence of similar fluorescent labeling of similarly prepared cells that have been transfected with other cDNA or pools of cDNA. If a defined pool of cDNA expression vectors is judged to be positive for interaction with a PRO polypeptide immunoadhesin, the individual cDNA species that comprise the pool are tested individually (the pool is "broken down") to determine the specific cDNA that encodes a receptor able to interact with the PRO polypeptide immunoadhesin.

In another embodiment of this assay, an epitope-tagged potential ligand PRO polypeptide (e.g. 8 histidine "His" tag) is allowed to interact with a panel of potential receptor PRO polypeptide molecules that have been expressed as fusions with the Fc domain of human IgG (immunoadhesins). Following a 1 hour co-incubation with the epitope tagged PRO polypeptide, the candidate receptors are each immunoprecipitated with protein A beads and the beads are washed. Potential ligand interaction is determined by western blot analysis of the immunoprecipitated complexes with antibody directed towards the epitope tag. An interaction is judged to occur if a band of the anticipated molecular weight of the epitope tagged protein is observed in the western blot analysis with a candidate receptor, but is not observed to occur with the other members of the panel of potential receptors.

Using these assays, the following receptor/ligand interactions have been herein identified:
(1) PRO943 binds to FHF1, PRO183 (FHF2), PRO184 (FHF3) and PRO185 (FHF4) and vice versa.
(2) PRO331 binds to PRO1133 and vice versa.
(3) PRO363 binds to PRO1387 and vice versa.
(4) PRO5723 binds to PRO1387 and vice versa.
(5) PRO1114 binds to PRO3301 and PRO9940 and vice versa.
(6) PRO9828 appears to be a novel fibroblast growth factor receptor (FGFR) ligand in that it binds to the known FGF receptors FGFR1, FGFR2IIIC, FGFR3IIIC and FGFR4. PRO9828 and agonists, therefore, will find use for activating the biological activities normally activated by FGF molecules including, for example, cell growth and proliferation. Antagonists of PRO9828 will find use in blocking the biological activities mediated through the FGF receptor.
(7) PRO1181 binds to PRO7170, PRO361 and PRO846.

Example 172

Tissue Expression Distribution

Oligonucleotide probes were constructed from the PRO polypeptide-encoding nucleotide sequences shown in the figures for use in quantitative PCR amplification reactions. The oligonucleotide probes were chosen so as to give an approximately 200–600 base pair amplified fragment from the 3' end of its associated template in a standard PCR reaction. The oligonucleotide probes were employed in standard quantitative PCR amplification reactions with cDNA libraries isolated from different human adult and/or fetal tissue sources and analyzed by agarose gel electrophoresis so as to obtain a quantitative determination of the level of expression of the PRO polypeptide-encoding nucleic acids in the various tissues tested. Knowledge of the expression pattern or the differential expression of the PRO polypeptide-encoding nucleic acids in various different human tissue types provides a diagnostic marker useful for tissue typing, with or without other tissue-specific markers, for determining the primary tissue source of a metastatic tumor, disease diagnosis, and the like. These assays provided the following results.

| DNA Molecule | Tissues w/ Significant Expression | Tissues w/o Significant Expression |
| --- | --- | --- |
| DNA16422-1209 | substantia nigra, dendrocytes, uterus | hippocampus |
| DNA16435-1208 | substantia nigra, dendrocytes, uterus | hippocampus |
| DNA26843-1389 | dendrocytes, heart, uterus, colon tumor | hippocampus, substantia nigra, cartilage |
| DNA26844-1394 | HUVEC, dendrocytes, cartilage | substantia nigra, hippocampus, uterus, prostate |
| DNA40621-1440 | prostate, uterus, colon tumor | brain, heart, HUVEC, cartilage |
| DNA44161-1434 | colon tumor, dendrocytes | substantia nigra, hippocampus, prostate, uterus |
| DNA44694-1500 | dendrocytes, hippocampus, prostate | colon tumor, substantia nigra, heart |
| DNA48320-1433 | prostate, uterus | colon tumor, brain, heart, cartilage |
| DNA49647-1398 | brain, heart, prostate, uterus | cartilage |
| DNA53913-1490 | hippocampus | substantia nigra, dendrocytes |
| DNA53978-1443 | dendrocytes, uterus, prostate | substantia nigra, colon tumor |
| DNA53996-1442 | spleen, prostate, uterus, hippocampus | substantia nigra, heart |
| DNA56050-1455 | prostate, uterus, cartilage, hippocampus | heart, colon tumor, dendrocytes |
| DNA56110-1437 | spleen, colon tumor, brain, prostate | heart |
| DNA56410-1414 | uterus, dendrocytes | hippocampus, substantia nigra, heart |
| DNA56436-1448 | substantia nigra, prostate, hippocampus | dendrocytes, heart, HUVEC |
| DNA56855-1447 | prostate, uterus | brain, cartilage, heart, colon tumor |
| DNA56860-1510 | colon tumor | prostate, uterus, dendrocytes |
| DNA56868-1478 | colon tumor, prostate | uterus, brain, heart, cartilage |
| DNA56869-1545 | prostate, uterus, cartilage | brain, colon tumor, spleen, heart |
| DNA57699-1412 | dendrocytes, hippocampus, prostate | sunstantia nigra, heart |
| DNA57704-1452 | brain, heart, spleen, uterus, prostate | colon tumor |
| DNA57710-1451 | dendrocytes, hippocampus, spleen, uterus | substantia nigra, heart |
| DNA57711-1501 | dendrocytes, hippocampus, heart, cartilage | substantia nigra |
| DNA57827-1493 | colon tumor, hippocampus, prostate | sunstantia nigra, dendrocytes, uterus |
| DNA58723-1588 | substantia nigra, cartilage uterus | hippocampus, dendrocytes, HUVEC |
| DNA58743-1609 | brain, prostate, uterus | colon tumor, heart, spleen, cartilage |
| DNA58846-1409 | hippocampus, dendrocytes | substantia nigra, uterus, prostate, colon tumor |
| DNA58849-1494 | prostate | brain, uterus, cartilage, heart, colon tumor |
| DNA58850-1495 | spleen, prostate, dendrocytes | hippocampus, substantia nigra, colon tumor |
| DNA59213-1487 | spleen, cartilage, prostate, substantia nigra | heart, hippocampus, dendrocytes |

-continued

| DNA Molecule | Tissues w/ Significant Expression | Tissues w/o Significant Expression |
|---|---|---|
| DNA59497-1496 | dendrocytes, prostate, uterus, heart | cartilage, hippocampus, substantia nigra |
| DNA59605-1418 | dendrocytes, prostate, uterus | hippocampus, substantia nigra, colon tumor |
| DNA59609-1470 | dendrocytes | substantia nigra, hippocampus, heart, prostate, uterus, spleen |
| DNA59612-1466 | prostate, dendrocytes | hippocampus, substantia nigra, uterus, colon tumor |
| DNA59616-1465 | dendrocytes, substantia nigra, colon tumor | hippocampus |
| DNA59619-1464 | dendrocytes, substantia nigra, colon tumor | hippocampus |
| DNA59625-1498 | brain, colon tumor, prostate, uterus | THP-1 macrophages |
| DNA59827-1426 | substantia nigra, prostate, uterus | hippocampus, dendrocytes, heart |
| DNA59828-1608 | dendrocytes, substantia nigra, colon tumor | hippocampus |
| DNA59853-1505 | prostate | brain, uterus, spleen, heart, colon tumor |
| DNA59854-1459 | cartilage | prostate, brain, heart, colon tumor |
| DNA60283-1484 | dendrocytes, spleen, prostate, uterus | hippocampus, substantia nigra, heart |
| DNA60619-1482 | dendrocytes, substantia nigra, colon tumor | hippocampus |
| DNA60625-1507 | cartilaqge | prostate, brain, heart, colon tumor |
| DNA60629-1481 | uterus, colon tumor, substantia nigra | hippocampus, dendrocytes, spleen, prostate |
| DNA61755-1554 | dendrocytes, substantia nigra, colon tumor | hippocampus |
| DNA64852-1589 | prostate, uterus | brain, heart, cartilage, colon tumor |
| DNA66308-1537 | prostate, heart uterus | brain, colon tumor, cartilage |
| DNA68869-1610 | spleen, prostate, heart, uterus, colon tumor, substantia nigra | hippocampus, dendrocytes, prostate |

Example 173

Isolation of cDNA Clones Encoding Human PRO846

A consensus sequence was obtained relative to a variety of EST sequences as described in Example 1 above, wherein the consensus sequence obtained is herein designated DNA39949. Based on the DNA39949 consensus sequence, oligonucleotides were synthesized: 1) to identify by PCR a cDNA library that contained the sequence of interest, and 2) for use as probes to isolate a clone of the full-length coding sequence for PRO846.

Forward and reverse PCR primers were synthesized:

forward PCR primer 5'-CCCTGCAGTGCACCTACAGGGAAG-3'  (SEQ ID NO:518)

reverse PCR primer 5'-CTGTCTTCCCCTGCTTGGCTGTGG-3'  (SEQ ID NO:519)

Additionally, a synthetic oligonucleotide hybridization probe was constructed from the consensus DNA39949 sequence which had the following nucleotide sequence Hybridization Probe
5'-GGTGCAGGAAGGGTGGGATCCTCTTCTCTCGCT GCTCTGGCCACATC-3' (SEQ ID NO:520)

In order to screen several libraries for a source of a full-length clone, DNA from the libraries was screened by PCR amplification with one of the PCR primer pairs identified above. A positive library was then used to isolate clones encoding the PRO846 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO846 [herein designated as DNA44196-1353] (SEQ ID NO:516) and the derived protein sequence for PRO846.

The entire nucleotide sequence of UNQ422 (DNA44196-1353) is shown in FIG. 329 (SEQ ID NO:516). Clone UNQ422 (DNA44196-1353) contains a single open reading frame with an apparent translational initiation site at nucleotide positions 25–27 and ending at the stop codon at nucleotide positions 1021–1023 (FIG. 329). The predicted polypeptide precursor is 332 amino acids long (FIG. 330). The full-length PRO846 protein shown in FIG. 330 has an estimated molecular weight of about 36,143 daltons and a pI of about 5.89. Important regions of the amino acid sequence of PRO846 include the signal peptide, the transmembrane domain, an N-glycosylation site, a sequence typical of fibrinogen beta and gamma chains C-terminal domain, and a sequence typical of Ig like V-type domain as shown in FIG. 330. Clone UNQ422 (DNA44196-1353) has been deposited with ATCC and is assigned ATCC deposit no. 209847.

Example 174

Isolation of cDNA Clones Encoding Human PRO363

A consensus sequence was obtained relative to a variety of EST sequences as described in Example 1 above, wherein the consensus sequence obtained is herein designated DNA42828. Based on the DNA42828 consensus sequence, oligonucleotides were synthesized: 1) to identify by PCR a cDNA library that contained the sequence of interest, and 2) for use as probes to isolate a clone of the full-length coding sequence for PRO363.

A pair of PCR primers (forward and reverse) were synthesized:

```
forward PCR primer (42828.f1)   5'-CCAGTGCACAGCAGGCAACGAAGC-3'   (SEQ ID NO:521)

reverse PCR primer (42828.r1)   5'-ACTAGGCTGTATGCCTGGGTGGGC-3'   (SEQ ID NO:522)
```

Additionally, a synthetic oligonucleotide hybridization probe was constructed from the consensus DNA42828 sequence which had the following nucleotide sequence
Hybridization Probe (42828.p1)
5'-GTATGTACAAAGCATCGGCATGGTTGCAGGAG CAGTGACAGGC-3' (SEQ ID NO:523)

In order to screen several libraries for a source of a full-length clone, DNA from the libraries was screened by PCR amplification with the PCR primer pair identified above. A positive library was then used to isolate clones encoding the PRO363 gene using the probe oligonucleotide and one of the PCR primers. RNA for construction of the cDNA libraries was isolated from human fetal kidney tissue (LIB227).

DNA sequencing of the clones isolated as described above gave the full-length DNA sequence for PRO363 [herein designated as UNQ318 (DNA45419-1252)] (SEQ ID NO:500) and the derived protein sequence for PRO363.

The entire nucleotide sequence of UNQ318 (DNA45419-1252) is shown in FIG. 313 (SEQ ID NO:500). Clone UNQ318 (DNA45419-1252) contains a single open reading frame with an apparent translational initiation site at nucleotide positions 190–192 and ending at the stop codon at nucleotide positions 1309–1311 (FIG. 313). The predicted polypeptide precursor is 373 amino acids long (FIG. 314). The full-length PRO363 protein shown in FIG. 314 has an estimated molecular weight of about 41,281 daltons and a pI of about 8.33. A transmembrane domain exists at amino acids 221 to 254 of the amino acid sequence shown in FIG. 314 (SEQ ID NO:501). The PRO363 polypeptide also possesses at least two myelin P0 protein domains from about amino acids 15 to 56 and from about amino acids 87 to 116. Clone UNQ318 (DNA45419-1252) has been deposited with ATCC on Feb. 5, 1998 and is assigned ATCC deposit no. 209616.

Analysis of the amino acid sequence of the full-length PRO363 polypeptide suggests that it possesses significant sequence similarity to the cell surface protein HCAR, thereby indicating that PRO363 may be a novel HCAR homolog. More specifically, an analysis of the Dayhoff database (version 35.45 SwissProt 35) evidenced significant homology between the PRO363 amino acid sequence and the following Dayhoff sequences, HS46KDA_1, HSU90716_1, MMCARH_1, MMCARHOM_1, MMU90715_1, A33_HUMAN, P_W14146, P_W14158, A42632 and B42632.

Example 175

Isolation of cDNA Clones Encoding a Human PRO9828

A consensus DNA sequence was assembled relative to other nucleic sequences using phrap as described in Example 1 above. This consensus sequence is herein designated DNA139814. Based on the DNA139814 consensus sequence, oligonucleotides were synthesized: 1) to identify by PCR a cDNA library that contained the sequence of interest, and 2) for use as probes to isolate a clone of the full-length coding sequence for PRO9828. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., *Current Protocols in Molecular Biology*, supra, with the PCR primer pair. A positive library was then used to isolate clones encoding the gene of interest using the probe oligonucleotide and one of the primer pairs.

PCR primers (forward and reverse) were synthesized:

```
5'-AATCTCAGCACCAGCCACTCAGAGCA-3'   (SEQ ID NO:524)
5'-GTTAAAGAGGGTGCCCTTCCAGCGA-3'    (SEQ ID NO:525)
5'-TATCCCAATGCCTCCCCACTGCTC-3'     (SEQ ID NO:526)
5'-GATGAACTTGGCGAAGGGCGGCA-3'      (SEQ ID NO:527)
```

RNA for construction of the cDNA libraries was isolated from human fetal liver tissue. The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for a full-length PRO9828 polypeptide (designated herein as DNA142238-2768 [FIG. 323, SEQ ID NO:510]) and the derived protein sequence for that PRO9828 polypeptide.

The full length clone identified above contained a single open reading frame with an apparent translational initiation site at nucleotide positions 232–234 and a stop signal at nucleotide positions 985–987 (FIG. 323, SEQ ID NO:510). The predicted polypeptide precursor is 251 amino acids long, has a calculated molecular weight of approximately 27,954 daltons and an estimated pI of approximately 9.22. Analysis of the full-length PRO9828 sequence shown in FIG. 324 (SEQ ID NO:511) evidences the presence of a variety of important polypeptide domains as shown in FIG. 324, wherein the locations given for those important polypeptide domains are approximate as described above. Chromosome mapping evidences that the PRO9828-encoding nucleic acid maps to chromosome 12p13 in humans. Clone DNA142238-2768 has been deposited with ATCC on Oct. 5, 1999 and is assigned ATCC deposit no. 819-PTA.

An analysis of the Dayhoff database (version 35.45 SwissProt 35), using the ALIGN-2 sequence alignment analysis of the full-length sequence shown in FIG. 324 (SEQ ID NO:511), evidenced sequence identity between the PRO9828 amino acid sequence and the following Dayhoff sequences: P_Y08581, AB018122_1, FGF3_HUMAN, P_R70824, S54407, P_R80780, P_Y23761, P_W92312, OMFGF6_1 and P_R80871.

Example 176

Isolation of cDNA Clones Encoding a Human PRO7170

DNA108722-2743 was identified by applying a proprietary signal sequence finding algorithm developed by Genentech, Inc. (South San Francisco, Calif.) upon ESTs as well as clustered and assembled EST fragments from public (e.g., Genbank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals.

Use of the above described signal sequence algorithm allowed identification of an EST cluster sequence from the LIFESEQ® database, Incyte Pharmaceuticals, Palo Alto, designated herein as CLU57836. This EST cluster sequence was then compared to a variety of expressed sequence tag (EST) databases which included public EST databases (e.g., Genbank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA58756.

In light of an observed sequence homology between the DNA58756 sequence and an EST sequence encompassed within clone no. 2251462 from the LIFESEQ® database, Incyte Pharmaceuticals, Palo Alto, Calif., clone no. 2251462 was purchased and the cDNA insert was obtained and sequenced. It was found herein that that cDNA insert encoded a full-length protein. The sequence of this cDNA insert is shown in FIG. 325 and is herein designated as DNA108722-2743.

Clone DNA108722-2743 contains a single open reading frame with an apparent translational initiation site at nucleotide positions 60–62 and ending at the stop codon at nucleotide positions 1506–1508 (FIG. 325). The predicted polypeptide precursor is 482 amino acids long (FIG. 326). The full-length PRO7170 protein shown in FIG. 326 has an estimated molecular weight of about 49,060 daltons and a pI of about 4.74. Analysis of the full-length PRO7170 sequence shown in FIG. 326 (SEQ ID NO:513) evidences the presence of a variety of important polypeptide domains as shown in FIG. 326, wherein the locations given for those important polypeptide domains are approximate as described above. Clone DNA108722-2743 has been deposited with ATCC on Aug. 17, 1999 and is assigned ATCC Deposit No. 552-PTA.

An analysis of the Dayhoff database (version 35.45 SwissProt 35), using the ALIGN-2 sequence alignment analysis of the full-length sequence shown in FIG. 326 (SEQ ID NO:513), evidenced sequence identity between the PRO7170 amino acid sequence and the following Dayhoff sequences: P_Y12291, I47141, D88733_1, DMC56G7_1, P_Y11606, HWP1_CANAL, HSMUC5BEX_1, HSU78550_1, HSU70136_1, and SGS3_DROME.

Example 177

Isolation of cDNA Clones Encoding Human PRO361

A consensus DNA sequence was assembled relative to other EST sequences using phrap as described in Example 1 above. This consensus sequence is herein designated DNA40654. Based on the DNA40654 consensus sequence, oligonucleotides were synthesized: 1) to identify by PCR a cDNA library that contained the sequence of interest, and 2) for use as probes to isolate a clone of the full-length coding sequence for PRO361.

Forward and reverse PCR primers were synthesized as follows:

```
forward PCR primer 5'-AGGGAGGATTATCCTTGACCTTTGAAGACC-3' (SEQ ID NO:528)

forward PCR primer 5'-GAAGCAAGTGCCCAGCTC-3'              (SEQ ID NO:529)

forward PCR primer 5'-CGGGTCCCTGCTCTTTGG-3'              (SEQ ID NO:530)

reverse PCR primer 5'-CACCGTAGCTGGGAGCGCACTCAC-3'        (SEQ ID NO:531)

reverse PCR primer 5'-AGTGTAAGTCAAGCTCCC-3'              (SEQ ID NO:532)
```

Additionally, a synthetic oligonucleotide hybridization probe was constructed from the consensus DNA40654 sequence which had the following nucleotide sequence Hybridization Probe 5'-GCTTCCTGACACTAAGGCTGTCTGCTAGTCAG AATTGCCTCAAAAAGAG-3' (SEQ ID NO:533)

In order to screen several libraries for a source of a full-length clone, DNA from the libraries was screened by PCR amplification with one of the PCR primer pairs identified above. A positive library was then used to isolate clones encoding the PRO361 gene using the probe oligonucleotide. RNA for construction of the cDNA libraries was isolated from human fetal kidney tissue.

DNA sequencing of the clones isolated as described above gave the full-length DNA sequence for PRO361 [herein designated as DNA45410-1250] (SEQ ID NO:514) and the derived protein sequence for PRO361.

The entire nucleotide sequence of DNA45410-1250 is shown in FIG. 327 (SEQ ID NO:514). Clone DNA45410-1250 contains a single open reading frame with an apparent translational initiation site at nucleotide positions 226–228 and ending at the stop codon at nucleotide positions 1519–1521 (FIG. 327). The predicted polypeptide precursor is 431 amino acids long (FIG. 328). The full-length PRO361 protein shown in FIG. 328 has an estimated molecular weight of about 46,810 daltons and a pI of about 6.45. In addition, regions of interest including the transmembrane domain (amino acids 380–409) and sequences typical of the arginase family of proteins (amino acids 3–14 and 39–57) are designated in FIG. 328. Clone DNA45410-1250 has been deposited with ATCC and is assigned ATCC deposit no. ATCC 209621.

Analysis of the amino acid sequence of the full-length PRO361 polypeptide suggests that portions of it possess significant homology to the mucin and/or chitinase proteins, thereby indicating that PRO361 may be a novel mucin and/or chitinase protein.

Example 178
Isolation of cDNA Clones Encoding a Human PRO183, PRO184, PRO185, PRO5723, PRO3301 or PRO9940

DNA molecules encoding the PRO183, PRO184, PRO185, PRO5723, PRO3301 or PRO9940 polypeptides shown in the accompanying figures were obtained through GenBank.

Deposit of Material

The following materials have been deposited with the American Type Culture Collection, 10801 University Blvd., Manassas, Va. 20110-2209, USA (ATCC):

TABLE 10

| Material | ATCC Dep. No. | Deposit Date |
|---|---|---|
| DNA45410-1250 | 209621 | Feb. 5, 1998 |
| DNA108722-2743 | 552-PTA | Aug. 17, 1999 |
| DNA142238-2768 | 819-PTA | Oct. 5, 1999 |
| DNA40981-1234 | 209439 | Nov. 7, 1997 |
| DNA45419-1252 | 209616 | Feb. 5, 1998 |
| DNA44196-1353 | 209847 | May 6, 1998 |
| DNA16422-1209 | 209929 | Jun. 2, 1998 |
| DNA16435-1208 | 209930 | Jun. 2, 1998 |
| DNA21624-1391 | 209917 | Jun. 2, 1998 |
| DNA23334-1392 | 209918 | Jun. 2, 1998 |
| DNA26288-1239 | 209792 | Apr. 21, 1998 |
| DNA26843-1389 | 203099 | Aug. 4, 1998 |
| DNA26844-1394 | 209926 | Jun. 2, 1998 |
| DNA30862-1396 | 209920 | Jun. 2, 1998 |
| DNA35680-1212 | 209790 | Apr. 21, 1998 |
| DNA40621-1440 | 209922 | Jun. 2, 1998 |
| DNA44161-1434 | 209907 | May 27, 1998 |
| DNA44694-1500 | 203114 | Aug. 11, 1998 |
| DNA45495-1550 | 203156 | Aug. 25, 1998 |
| DNA47361-1154 | 209431 | Nov. 7, 1997 |
| DNA47394-1572 | 203109 | Aug. 11, 1998 |
| DNA48320-1433 | 209904 | May 27, 1998 |
| DNA48334-1435 | 209924 | Jun. 2, 1998 |
| DNA48606-1479 | 203040 | Jul. 1, 1998 |
| DNA49141-1431 | 203003 | Jun. 23, 1998 |
| DNA49142-1430 | 203002 | Jun. 23, 1998 |
| DNA49143-1429 | 203013 | Jun. 23, 1998 |
| DNA49647-1398 | 209919 | Jun. 2, 1998 |
| DNA49819-1439 | 209931 | Jun. 2, 1998 |
| DNA49820-1427 | 209932 | Jun. 2, 1998 |
| DNA49821-1562 | 209981 | Jun. 16, 1998 |
| DNA52192-1369 | 203042 | Jul. 1, 1998 |
| DNA52598-1518 | 203107 | Aug. 11, 1998 |
| DNA53913-1490 | 203162 | Aug. 25, 1998 |
| DNA53978-1443 | 209983 | Jun. 16, 1998 |
| DNA53996-1442 | 209921 | Jun. 2, 1998 |
| DNA56041-1416 | 203012 | Jun. 23, 1998 |
| DNA56047-1456 | 209948 | Jun. 9, 1998 |
| DNA56050-1455 | 203011 | Jun. 23, 1998 |
| DNA56110-1437 | 203113 | Aug. 11, 1998 |
| DNA56113-1378 | 203049 | Jul. 1, 1998 |
| DNA56410-1414 | 209923 | Jun. 2, 1998 |
| DNA56436-1448 | 209902 | May 27, 1998 |
| DNA56855-1447 | 203004 | Jun. 23, 1998 |
| DNA56859-1445 | 203019 | Jun. 23, 1998 |
| DNA56860-1510 | 209952 | Jun. 9, 1998 |
| DNA56865-1491 | 203022 | Jun. 23, 1998 |
| DNA56866-1342 | 203023 | Jun. 23, 1998 |
| DNA56868-1209 | 203024 | Jun. 23, 1998 |
| DNA56869-1545 | 203161 | Aug. 25, 1998 |
| DNA56870-1492 | 209925 | Jun. 2, 1998 |
| DNA57033-1403 | 209905 | May 27, 1998 |
| DNA57037-1444 | 209903 | May 27, 1998 |
| DNA57129-1413 | 209977 | Jun. 16, 1998 |
| DNA57690-1374 | 209950 | Jun. 9, 1998 |
| DNA57693-1424 | 203008 | Jun. 23, 1998 |
| DNA57694-1341 | 203017 | Jun. 23, 1998 |
| DNA57695-1340 | 203006 | Jun. 23, 1998 |
| DNA57699-1412 | 203020 | Jun. 23, 1998 |
| DNA57702-1476 | 209951 | Jun. 9, 1998 |
| DNA57704-1452 | 209953 | Jun. 9, 1998 |
| DNA57708-1411 | 203021 | Jun. 23, 1998 |

TABLE 10-continued

| Material | ATCC Dep. No. | Deposit Date |
|---|---|---|
| DNA57710-1451 | 203048 | Jul. 1, 1998 |
| DNA57711-1501 | 203047 | Jul. 1, 1998 |
| DNA57827-1493 | 203045 | Jul. 1, 1998 |
| DNA57834-1339 | 209954 | Jun. 9, 1998 |
| DNA57836-1338 | 203025 | Jun. 23, 1998 |
| DNA57838-1337 | 203014 | Jun. 23, 1998 |
| DNA57844-1410 | 203010 | Jun. 23, 1998 |
| DNA58721-1475 | 203110 | Aug. 11, 1998 |
| DNA58723-1588 | 203133 | Aug. 18, 1998 |
| DNA58737-1473 | 203136 | Aug. 18, 1998 |
| DNA58743-1609 | 203154 | Aug. 25, 1998 |
| DNA58846-1409 | 209957 | Jun. 9, 1998 |
| DNA58848-1472 | 209955 | Jun. 9, 1998 |
| DNA58849-1494 | 209958 | Jun. 9, 1998 |
| DNA58850-1495 | 209956 | Jun. 9, 1998 |
| DNA58853-1423 | 203016 | Jun. 23, 1998 |
| DNA58855-1422 | 203018 | Jun. 23, 1998 |
| DNA59205-1421 | 203009 | Jun. 23, 1998 |
| DNA59211-1450 | 209960 | Jun. 9, 1998 |
| DNA59213-1487 | 209959 | Jun. 9, 1998 |
| DNA59214-1449 | 203046 | Jul. 1, 1998 |
| DNA59215-1425 | 209961 | Jun. 9, 1998 |
| DNA59220-1514 | 209962 | Jun. 9, 1998 |
| DNA59488-1603 | 203157 | Aug. 25, 1998 |
| DNA59493-1420 | 203050 | Jul. 1, 1998 |
| DNA59497-1496 | 209941 | Jun. 4, 1998 |
| DNA59588-1571 | 203106 | Aug. 11, 1998 |
| DNA59603-1419 | 209944 | Jun. 9, 1998 |
| DNA59605-1418 | 203005 | Jun. 23, 1998 |
| DNA59606-1471 | 209945 | Jun. 9, 1998 |
| DNA59607-1497 | 209957 | Jun. 9, 1998 |
| DNA59609-1470 | 209963 | Jun. 9, 1998 |
| DNA59610-1559 | 209990 | Jun. 16, 1998 |
| DNA59612-1466 | 209947 | Jun. 9, 1998 |
| DNA59613-1417 | 203007 | Jun. 23, 1998 |
| DNA59616-1465 | 209991 | Jun. 16, 1998 |
| DNA59619-1464 | 203041 | Jul. 1, 1998 |
| DNA59620-1463 | 209989 | Jun. 16, 1998 |
| DNA59625-1498 | 209992 | Jun. 17, 1998 |
| DNA59767-1489 | 203108 | Aug. 11, 1998 |
| DNA59776-1600 | 203128 | Aug. 18, 1998 |
| DNA59777-1480 | 203111 | Aug. 11, 1998 |
| DNA59820-1549 | 203129 | Aug. 18, 1998 |
| DNA59827-1426 | 203089 | Aug. 4, 1998 |
| DNA59828-1608 | 203158 | Aug. 25, 1998 |
| DNA59838-1462 | 209976 | Jun. 16, 1998 |
| DNA59839-1461 | 209988 | Jun. 16, 1998 |
| DNA59841-1460 | 203044 | Jul. 1, 1998 |
| DNA59842-1502 | 209982 | Jun. 16, 1998 |
| DNA59846-1503 | 209978 | Jun. 16, 1998 |
| DNA59847-1511 | 203098 | Aug. 4, 1998 |
| DNA59848-1512 | 203088 | Aug. 4, 1998 |
| DNA59849-1504 | 209986 | Jun. 16, 1998 |
| DNA59853-1505 | 209985 | Jun. 16, 1998 |
| DNA59854-1459 | 209974 | Jun. 16, 1998 |
| DNA60283-1484 | 203043 | Jul. 1, 1998 |
| DNA60615-1483 | 209980 | Jun. 16, 1998 |
| DNA60619-1482 | 209993 | Jun. 16, 1998 |
| DNA60621-1516 | 203091 | Aug. 4, 1998 |
| DNA60622-1525 | 203090 | Aug. 4, 1998 |
| DNA60625-1507 | 209975 | Jun. 16, 1998 |
| DNA60627-1508 | 203092 | Aug. 4, 1998 |
| DNA60629-1481 | 209979 | Jun. 16, 1998 |
| DNA61755-1554 | 203112 | Aug. 11, 1998 |
| DNA61873-1574 | 203132 | Aug. 18, 1998 |
| DNA62814-1521 | 203093 | Aug. 4, 1998 |
| DNA62872-1509 | 203100 | Aug. 4, 1998 |
| DNA62876-1517 | 203095 | Aug. 4, 1998 |
| DNA62881-1515 | 203096 | Aug. 4, 1998 |
| DNA64852-1589 | 203127 | Aug. 18, 1998 |
| DNA64884-1527 | 203155 | Aug. 25, 1998 |
| DNA64890-1612 | 203131 | Aug. 18, 1998 |
| DNA65412-1523 | 203094 | Aug. 4, 1998 |
| DNA66308-1537 | 203159 | Aug. 25, 1998 |
| DNA66309-1538 | 203235 | Sep. 15, 1998 |
| DNA67004-1614 | 203115 | Aug. 11, 1998 |
| DNA68869-1610 | 203164 | Aug. 25, 1998 |
| DNA68872-1620 | 203160 | Aug. 25, 1998 |
| DNA71159-1617 | 203135 | Aug. 18, 1998 |

These deposit were made under the provisions of the Budapest Treaty on the International Recognition of the Deposit of Microorganisms for the Purpose of Patent Procedure and the Regulations thereunder (Budapest Treaty). This assures maintenance of a viable culture of the deposit for 30 years from the date of deposit. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (532 sequences)

SEQ ID NO: 1 - DNA, 1943 bp, Homo sapiens
cggacgcgtgggtgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatttgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatg

SEQ ID NO: 2 - protein, 345 aa, Homo sapiens
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 3 - DNA, 43 bp, Artificial Sequence
  Synthetic oligonucleotide probe
tgtaaaacgacggccagttaaatagacctgcaattattaatct

SEQ ID NO: 4 - DNA, 41 bp, Artificial Sequence
  Synthetic oligonucleotide probe
caggaaacagctatgaccacctgcacacctgcaaatccatt

SEQ ID NO: 5 - DNA, 3033 bp, Homo sapiens
gaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctaatctgctggcattgagctggggctgggtcaccaaacccttcccaaaaggaccttatctctttcttgcacacatgcctctctcccacttttcccaacccccacatttgcaactagaaaaagttgcccataaaattgctctgcccttgacaggttctgttatttattgacttttgccaaggctggtcacaacaatcatattcacgttattttccccttttggtggcagaactgttaccaatagggggagaagacagccacggatgaagcgtttctcagcttttggaattgcttcgactgacatccgttgttaaccgtttgccactcttcagatattttttataaaaaaagtaccactgagttcatgagggccacagattggttattaatgagatacgagggttggtgctgggtgtttgtttcctgagctaagtgatcaagactgtagtggagttgcagctaacatgggttaggtttaaaccatgggggatgcacccctttgcgtttcatatgtagccctactggctttgtgtagctggagtagttgggttgctttgtgttaggaggatccagatcatgttggctacagggagatgctctctttgagaggtcctgggcattgattcccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacttctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatatttctgacagtgagtgacccggagtctctggtgtaccctcttaccagtcagctgcctgcgagcagtcattttttcctaaaggtttacaagtatttagaacttttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttg

SEQ ID NO: 6 - protein, 251 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 7 - DNA, 1373 bp, Homo sapiens
ggggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagttaactgcaaaggagggcatgtgataactccaggaagcccagagccggtgattttggtggcctgtgttccccttgtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactg

SEQ ID NO: 8 - protein, 367 aa, Homo sapiens
MAAEEEDEVEWVVESIAGFLRGPDWSIPILDFVEQKCEVNCKGGHVITPGSPEPVILVACVPLVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKGLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 9 - DNA, 418 bp, Homo sapiens
gggcacagcacatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccatttttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaa

SEQ ID NO: 10 - DNA, 22 bp, Artificial Sequence
  Synthetic oligonucleotide probe
ttgacctatacagagattcatc

SEQ ID NO: 11 - DNA, 23 bp, Artificial Sequence
  Synthetic oligonucleotide probe
ctaagaacttccctcaggatttt

SEQ ID NO: 12 - DNA, 40 bp, Artificial Sequence
  Synthetic oligonucleotide probe
atgaagatcaatttcaagaagcatgcacttctcctcttgc

SEQ ID NO: 13 - DNA, 2886 bp, Homo sapiens
gcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaggggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacct

SEQ ID NO: 14 - protein, 424 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 15 - DNA, 755 bp, Homo sapiens
cgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaacttta

SEQ ID NO: 16 - DNA, 20 bp, Artificial Sequence
  Synthetic oligonucleotide probe
ctatacctactgtagcttct

SEQ ID NO: 17 - DNA, 20 bp, Artificial Sequence
  Synthetic oligonucleotide probe
tcagagaattccttccagga

SEQ ID NO: 18 - DNA, 40 bp, Artificial Sequence
  Synthetic oligonucleotide probe
acagtgctgtagtcatcctgtaatatgctccttgtcaaca

SEQ ID NO: 19 - DNA, 2142 bp, Homo sapiens
cggacgcgtgggcggacgcgtgggcggacgcgtggggccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaaccgagcagactgagcgggattctgccaccgcctatcggatgactgtggaagtgctgggcacagtgctgggcacggcgatccagggacaaatcgtgggccaagcagacacgccttgtttccaggacttcaatagctctacagtagcttcacaaagtgccaaccatacacatggcaccacttcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagc

SEQ ID NO: 20 - protein, 458 aa, Homo sapiens [sequence omitted]

SEQ ID NO: 21 - DNA, 571 bp, Homo sapiens
gggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccat

SEQ ID NO: 22 - DNA, 1173 bp, Homo sapiens
ggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatg

SEQ ID NO: 23 - protein, 266 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 24 - DNA, 485 bp, Homo sapiens
  unsure 14, 484: unknown base
cggacgcttgggcngcgccagcggccagcgctagtcggtctggtaagtgcctgatgccgagttccgtctctcgggtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtanc

SEQ ID NO: 25 - DNA, 40 bp, Artificial Sequence
  Synthetic oligonucleotide probe
acctgttagaaatgtggtggtttcagcaaggcctcagttt

SEQ ID NO: 26 - DNA, 46 bp, Artificial Sequence
  Synthetic oligonucleotide probe
ggagatagctgctatgggttcttcaggcacaacttaacatgggaag

SEQ ID NO: 27 - DNA, 1399 bp, Homo sapiens
cccacgcgtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgac

SEQ ID NO: 28 - protein, 264 aa, Homo sapiens
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 29 - DNA, 1292 bp, Homo sapiens
ccgaggcgggaggagcccgagggggcgcgagccccgcatgaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgcaaaaa

SEQ ID NO: 30 - protein, 347 aa, Homo sapiens
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 31 - DNA, 478 bp, Homo sapiens
ccacggtgtccgttcttcgcccggcggcagctgtccccgaggcgggaggagcccgaggggcgcgagccccgcatgaatcattgtagtcaatcattttccagttctcagccgttcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttgtggagctcac

SEQ ID NO: 32 - DNA, 3531 bp, Homo sapiens
cccacgcgtccgcccacgcgtccggctgaacacctcttctttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactccgagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccagggggtgagcggggcccaccctgcccagctcagggattggcgggcgatgttaccccctcagggattggcgggcggaagtcccgcccctcgccggctgaggggccgccctgagggccagcactggcgtct

SEQ ID NO: 33 - protein, 1003 aa, Homo sapiens
MSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 34 - DNA, 43 bp, Artificial Sequence
  Synthetic oligonucleotide probe
tgactgcactaccccgtggcaagctgttgagccagctcagctg

SEQ ID NO: 35 - DNA, 1395 bp, Homo sapiens
cggacgcgtgggcggacgcgtgggggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactc

SEQ ID NO: 36 - protein, 321 aa, Homo sapiens
RTRGRTRGGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 37 - DNA, 22 bp, Artificial Sequence
  Synthetic oligonucleotide probe
tcgtgcccaggggctgatgtgc

SEQ ID NO: 38 - DNA, 24 bp, Artificial Sequence
  Synthetic oligonucleotide probe
gtctttacccagccccgggatgcg

SEQ ID NO: 39 - DNA, 50 bp, Artificial Sequence
  Synthetic oligonucleotide probe
ggcctaatccaacgttctgtcttcaatctgcaaatctatggggtcctggg

SEQ ID NO: 40 - DNA, 1365 bp, Homo sapiens
gagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgactcccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgc

SEQ ID NO: 41 - protein, 566 aa, Homo sapiens [sequence omitted]

SEQ ID NO: 42 - DNA, 380 bp, Homo sapiens
  unsure 44, 118, 172, 183: unknown base
gtacctcagcgcgagcgccaggcgtccggccgccgtggctatgntcgtgtccgatttccgcaaagagttctacgaggtggtccagagccagagggtccttctcttcgtggcctcggangtggatgctctgtgtgcgtgcaagatccttcaggccttgttccagtgtgaccangtgcaatatangctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgttgtcaatgtatacaacgataccc

SEQ ID NO: 43 - DNA, 25 bp, Artificial Sequence
  Synthetic oligonucleotide probe
ttccgcaaagagttctacgaggtgg

SEQ ID NO: 44 - DNA, 26 bp, Artificial Sequence
  Synthetic oligonucleotide probe
attgacaacattgactggcctatggg

SEQ ID NO: 45 - DNA, 50 bp, Artificial Sequence
  Synthetic oligonucleotide probe
gtggatgctctgtgtgcgtgcaagatccttcaggccttgttccagtgtga

SEQ ID NO: 46 - DNA, 3089 bp, Homo sapiens
caggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggtgacagccgccctgggtcccgtctgggcagcgctcctgctctttctcctgatgtgtgagatccgtatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgaggagaggacccaggagtgtgggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaaaaaaa

SEQ ID NO: 47 - protein, 259 aa, Homo sapiens [sequence omitted]

SEQ ID NO: 48 - DNA, 25 bp, Artificial Sequence
  Synthetic oligonucleotide probe
ccagacgctgctcttcgaaagggtc

SEQ ID NO: 49 - DNA, 23 bp, Artificial Sequence
  Synthetic oligonucleotide probe
ggtccccgtaggccaggtccagc

SEQ ID NO: 50 - DNA, 50 bp, Artificial sequence
  Synthetic oligonucleotide probe
ctacttcttcagcctcaatgtgcacagctggaattacaaggagacgtacg

SEQ ID NO: 51 - DNA, 2768 bp, Homo sapiens
actcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggtcctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatttataagagatcctttcccatttattctgggaagatgtttttcaaactcagagacaaggactttggtttttgtaagacaaacgatgatatgaaggccttttgtaagaaaaaataaaagatgaagtgtgaaa

SEQ ID NO: 52 - protein, 673 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTAPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 53 - DNA, 23 bp, Artificial Sequence
  Synthetic oligonucleotide probe
tcttcagccgcttgcgcaacctc

SEQ ID NO: 54 - DNA, 24 bp, Artificial Sequence
  Synthetic oligonucleotide probe
ttgctcacatccagctcctgcagg

SEQ ID NO: 55 - DNA, 41 bp, Artificial Sequence
  Synthetic oligonucleotide probe
tggatgttgtccagacaaccagctggagctgtatccgaggc

SEQ ID NO: 56 - DNA, 3462 bp, Homo sapiens
gaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 57 - protein, 811 aa, Homo sapiens
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 58 - DNA, 24 bp, Artificial Sequence
  Synthetic oligonucleotide probe
tcccaccaggtatcataaactgaa

SEQ ID NO: 59 - DNA, 27 bp, Artificial Sequence
  Synthetic oligonucleotide probe
ttatagacaatctgttctcatcagaga

SEQ ID NO: 60 - DNA, 40 bp, Artificial Sequence
  Synthetic oligonucleotide probe
aaaaagcatacttggaatggcccaaggataggtgtaaatg

SEQ ID NO: 61 - DNA, 3772 bp, Homo sapiens
gggggctttcttgggcttggctgcttggaacacctgcctccaaggaccggcctcggaggggtcgccgggaaagggagggaagaaggaagggcggggccggcccccctgcgcccgccccgcgcctctgcgcgcccctgtccgccccggcccagcccagcccagccccgcgggccggtcacacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtatccctacgacctggtgcggtccccctggaagacgcaggaacacacccccacccccgatgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacccttaaaaaaaaaaaaaaaaaaaaaaaaaaaaaaaaaaaaaaaaaaaaaaaa

SEQ ID NO: 62 - protein, 756 aa, Homo sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGRKRRQRG

SEQ ID NO: 63 - DNA, 24 bp, Artificial Sequence
  Synthetic oligonucleotide probe
gttctcaatgagctacccgtcccc

SEQ ID NO: 64 - DNA, 24 bp, Artificial Sequence
  Synthetic oligonucleotide probe
cgcgatgtagtggaactcgggctc

SEQ ID NO: 65 - DNA, 50 bp, Artificial Sequence
  Synthetic oligonucleotide probe
atccgcataaaccctcagtcctggtttgataatgggagcatctgcatgag

SEQ ID NO: 66 - DNA, 2854 bp, Homo sapiens
ctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttctaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaaaaaaaaaaaaaaaaaaaaaaaa

SEQ ID NO: 67 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 68 - DNA, 410 bp, Homo sapiens
  unsure 206, 217, 387: unknown base
gctctgaagaccaagctgaaagagtgtgaggcctctaaagatcaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggnatgtattgggnggcgccattgaatacagatgggagactgttggagtattatagactgtacaacccactggatgatttgctattgtatataaatgctcgagagttgcggatcacctatggccaaggtagtggtacagcagtttacaacaacaacatgtacgtcaacatgtacaacaccgggnatattgccagagttaacctgacc

SEQ ID NO: 69 - DNA, 24 bp, Artificial Sequence
  Synthetic oligonucleotide probe
agctgtggtcatggtggtgtggtg

SEQ ID NO: 70 - DNA, 24 bp, Artificial Sequence
  Synthetic oligonucleotide probe
ctaccttggccataggtgatccgc

SEQ ID NO: 71 - DNA, 42 bp, Artificial Sequence
  Synthetic oligonucleotide probe
catcagcaaaccgtctgtggttcagctcaactggagagggtt

SEQ ID NO: 72 - DNA, 3127 bp, Homo sapiens
tctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtccaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgttttgaaagtcactttgaaagttagttttgggcccagcacggtagctcacccttggtaatcccagcactttgggagcttaagtgggtagattacttgagcccaggaattcagaccagcttggcacatggtgaacctgttctataaaaataatctggctttgagcatatgcctgtggtccagcactgagaggctagtgaagattgctgagcccagagccaaaggttgcagtgagcaagtcacgtcactgcactctagctggcacagagtaagccaaaaaaatatatatatattgaaatcaaggaggcaaaattttgacagggaaggaagtaactgcaaaaccactaggctttagtaggtacttatataaaatctagtccagttctctcatttaaaaaaatgaagacactgaaatacagacttaaatagctcagatagctaattaggaaatttcaagttggccaataatagcattctctctgacatttaaaaataatttctattcaaaatacatgcatattgatttacacctcatactgtgataattaatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaaaaaa

SEQ ID NO: 73 - protein, 453 aa, Homo sapiens [sequence omitted]

SEQ ID NO: 74 - DNA, 480 bp, Homo sapiens
  unsure 48, 163: unknown base
gcgagaaagaagctgtctccatcttgtctgtatcccgctgcttcttgngacgttgtggagatggggagcgtccctggggctgtgctccatggcgagctggataccatgtttgtgtggaagtgccccgtgtttgctatgccgatgctgtcctagtggaaacaantccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggc

SEQ ID NO: 75 - DNA, 438 bp, Homo sapiens
  unsure 32, 65, 92, 121, 142, 154, 170, 293, 315, 323: unknown base
gttattgtgaactttgtggagatgggaggtcntggggctgtgttccatggcgagctggataccangtttgtgtggaagtgccccgtgtttgntatgccgatgctgtcctagtggaaacaantccactgtaattagattgatntatgcacttttnttgcttgttggagtangtgtagcttgtgtaatgttgataccaggaatggaagaacaactgaataagattcctggattttgtgagaatgagaaaggtgttgtcccttgtaacattttggttggctataaagctgtatatngtttgtgctttggtttggctangttctatnttcttctctctttactaatgatcaaagtgaagagtagcagtgatcctagagctgcagtgcacaatggattttggttttttaaatttgctgcagcaattgcaattattattggggc

SEQ ID NO: 76 - DNA, 473 bp, Homo sapiens
  unsure 48: unknown base
aagaagctgtctccatcttgtctgtatccgctgctcttgtgaacgttntggagatggggagcgtccttggggttgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggc

SEQ ID NO: 77 - DNA, 666 bp, Homo sapiens
  unsure 21, 111: unknown base
gctgtccttagtggaaacaantccaacttgtaacttggattgatctatgcactttttccttgcttgttggagtatgtgtagctttgtgtaatgttgttcccaggattggangaacaactgaataagattcctggatttttgtgagaatgagaaaggtgttgtccccttgtaacatttttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatg

SEQ ID NO: 78 - DNA, 22 bp, Artificial Sequence
  Synthetic oligonucleotide probe
atgtttgtgtggaagtgccccg

SEQ ID NO: 79 - DNA, 18 bp, Artificial Sequence
  Synthetic oligonucleotide probe
gtcaacatgctcctctgc

SEQ ID NO: 80 - DNA, 26 bp, Artificial Sequence
  Synthetic oligonucleotide probe
aatccattgtgcactgcagctctagg

SEQ ID NO: 81 - DNA, 23 bp, Artificial Sequence
  Synthetic oligonucleotide probe
gagcatgccaccactggactgac

SEQ ID NO: 82 - DNA, 54 bp, Artificial Sequence
  Synthetic oligonucleotide probe
gccgatgctgtcctagtggaaacaactccactgtaactagattgatctatgcac

SEQ ID NO: 83 - DNA, 3906 bp, Homo sapiens
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaa

SEQ ID NO: 84 - protein, 867 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 85 - DNA, 19 bp, Artificial Sequence
  Synthetic oligonucleotide probe
gaagccggctgtctgaatc

SEQ ID NO: 86 - DNA, 18 bp, Artificial Sequence
  Synthetic oligonucleotide probe
ggccagctatctccgcag

SEQ ID NO: 87 - DNA, 18 bp, Artificial Sequence
  Synthetic oligonucleotide probe
aagggcctgcaagagaag

SEQ ID NO: 88 - DNA, 18 bp, Artificial Sequence
  Synthetic oligonucleotide probe
cactgggacaactgtggg

SEQ ID NO: 89 - DNA, 18 bp, Artificial Sequence
  Synthetic oligonucleotide probe
cagaggcaacgtggagag

SEQ ID NO: 90 - DNA, 21 bp, Artificial Sequence
  Synthetic oligonucleotide probe
aagtattgtcatacagtgttc

SEQ ID NO: 91 - DNA, 24 bp, Artificial Sequence
  Synthetic oligonucleotide probe
tagtacttgggcacgaggttggag

SEQ ID NO: 92 - DNA, 24 bp, Artificial Sequence
  Synthetic oligonucleotide probe
tcataccaactgctggtcattggc

SEQ ID NO: 93 - DNA, 45 bp, Artificial Sequence
  Synthetic oligonucleotide probe
ctcaagctgctggacacggagcggccggtgaatcggtttcacttg

SEQ ID NO: 94 - DNA, 971 bp, Homo sapiens
aacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacacccctcaccacctccaccaccaccaccacccccaccgccaccatccccgccacgctcgctgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaagctttaaaaaaaaaaaaaaaaaaaaa

SEQ ID NO: 95 - protein, 115 aa, Homo sapiens
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHTPHHLHHHHHPHRHHPRHAR

SEQ ID NO: 96 - DNA, 1312 bp, Homo sapiens
ggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctggaaaaaaaaaaaaaaaaa

SEQ ID NO: 97 - protein, 313 aa, Homo sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 98 - DNA, 725 bp, Homo sapiens
ccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaacttaaaaaaaaaaaaaaaaaa

SEQ ID NO: 99 - protein, 201 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 100 - DNA, 705 bp, Homo sapiens
cccgggaacgtgttcctggctgccgcacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccaccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 101 - DNA, 543 bp, Homo sapiens
ccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaacttaaaa

SEQ ID NO: 102 - DNA, 1316 bp, Homo sapiens
ctgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccactg

SEQ ID NO: 103 - protein, 157 aa, Homo sapiens
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 104 - DNA, 545 bp, Homo sapiens
ttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggc

SEQ ID NO: 105 - DNA, 490 bp, Homo sapiens
  unsure 31, 39, 108, 145, 179, 219, 412, 479: unknown base
tggacggacctgaaaaaaatgtttggatttntagagggnttgagatgttcagaatgcatgactgggggaaaagcgcaaatactattgcttccattgctgctggtgtantattttttacaggctggtggattatcatagatgcagntgttatttatcccaccatgaaagatttcaaccantcataccatgcctgtggtgttatagcaaccatagccttcntaatgattaatgcagtatcgaatggacaagtccgaggtgatagttacagtgaaggttgtttgggtcaaacaggtgctcgcatttggcttttcgttggtttcatgttggcctttggatctctgattgcatctatgtggattctttttggaggttatgttgctaaagaaaaagacatagtataccctggaattgntgtatttttccagaatgccttcatcttttttggagggctggtttttaagtttggccgcactgaaganttatggcagtg

SEQ ID NO: 106 - DNA, 466 bp, Homo sapiens
  unsure 26, 38, 81, 115, 207, 329, 380, 446, 449: unknown base
ggacaccgggttccggaccaatgcangacggggtggantgacctgaaaaaaatgtttggatttttagagggcttgagatgntcagaatgcattgactgggggaaaagcgcaatantattgctttccattgctgctggtgtactattttttacagggtggtggattatcatagatgcagctgttatttatcccaccatgaaagatttnaaccactcataccatgcctgtggtgttatagcaaccatagccttcctaatgattaatgcagtatcgaatggacaagtccgaggtgatagttacagtgaaggttgtttgggtcaaacaggtgntcgcatttggcttttcgttggtttcatgttggcctttggatttctgattgnattctatgcggattcttcttggaggttatgttgctaaagaaaaagacatagtataccctggaattnctntatttttccagaatgcc

SEQ ID NO: 107 - DNA, 377 bp, Homo sapiens
  unsure 52, 67, 70, 78, 105, 144, 150, 209, 266, 268, 282, 310, 331, 356: unknown base
tagagggcttgagatgctcagaatgcattgactggggggaaaagcgcaatantattgcttccattgntgntggtgtantatttttttacaggctggtggattatnatagatgcagctgttatttatcccaccatgaaagatttnaaccantcataccatgcctgtggtgttatagcaaccatagccttcctaatgattaatgcagtatngaatggacaagtccgaggtgatagttacagtgaaggttgtttgggtcaaacaggtgntngcatttggcttttngttggtttcatgttggcctttggatctntgattgcatttatgtggattntttttggaggttatgttgctaaagnaaaagacatagtataccctgt

SEQ ID NO: 108 - DNA, 552 bp, Homo sapiens
  unsure 12, 25, 65, 130, 437, 537: unknown base
gggaggctgtgnccgttttgttttnttggctaaaatcgggggagtgaggcggcccggcgcggcgngacaccgggttccgggaaccattgcacgacggggtggactgacctgaaaaaaatgtttggatttntagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatntctgattgcatctatgtggattctttttggaggttatgttgctaaagaaaaagacatagtataccctggaattgctgtatttttccagaatgccttcatnttttttggagggctg

SEQ ID NO: 109 - DNA, 23 bp, Artificial Sequence
  Synthetic oligonucleotide probe
gggtggatggtactgctgcatcc

SEQ ID NO: 110 - DNA, 26 bp, Artificial Sequence
  Synthetic oligonucleotide probe
tgttgtgctgtgggaaatcagatgtg

SEQ ID NO: 111 - DNA, 46 bp, Artificial Sequence
  Synthetic oligonucleotide probe
gtgtctggaggctgtggccgttttgttttcttgggctaaaatcggg

SEQ ID NO: 112 - DNA, 3004 bp, Homo sapiens
cgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaaaaaaaaaaaaaaa

SEQ ID NO: 113 - protein, 610 aa, Homo sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 114 - DNA, 1701 bp, Homo sapiens
gcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttggtaagtagactttagtggaaggctaataatattaacatcagaagaatttgtggtttatagcggccacaactttttcagctttcatgatccagatttgcttgtattaagaccaaatattcagttgaacttccttcaaattcttgttaatggatataacacatggaatctacatgtaaatgaaagttggtggagtccacaatttttctttaaaatgattagtttggctgattgcccctaaaaagagagatctgataaatggctctttttaaattttctctgagttggaattgtcagaatcattttttacattagattatcataattttaaaaatttttctttagtttttcaaaattttgtaaatggtggctatagaaaaacaacatgaaatattatacaatattttgcaacaatgccctaagaattgttaaaattcatggagttatttgtgcagaatgactccagagagctctactttctgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaaaaaaaaaaaaaaaaaaaaaaaaaaaaaaaaaaaaaaaaaaaaaaaaaaaaaaaaaaaaaaaaaaaaaaaa

SEQ ID NO: 115 - protein, 301 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLVSRL

SEQ ID NO: 116 - DNA, 584 bp, Homo sapiens
cttcccagccctgtgccccaaagcacctggagcatatagccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaac

SEQ ID NO: 117 - protein, 123 aa, Homo sapiens
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 118 - DNA, 3402 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccagtgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacacaaaa

SEQ ID NO: 119 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 120 - DNA, 20 bp, Artificial Sequence
  Synthetic oligonucleotide probe
cgagatgacgccgagccccc

SEQ ID NO: 121 - DNA, 21 bp, Artificial Sequence
  Synthetic oligonucleotide probe
cggttcgacacgcggcaggtg

SEQ ID NO: 122 - DNA, 45 bp, Artificial Sequence
  Synthetic oligonucleotide probe
tgctgctcctgctgccgccgctgctgctgggggccttcccgccgg

SEQ ID NO: 123 - DNA, 4420 bp, Homo sapiens
cccagctgaggagccctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacatggttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcacagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaagagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcggacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagggtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcgaaaaaa

SEQ ID NO: 124 - protein, 1184 aa, Homo sapiens [sequence omitted]

SEQ ID NO: 125 - DNA, 22 bp, Artificial Sequence
  Synthetic oligonucleotide probe
ctggtgcctcaacagggagcag

SEQ ID NO: 126 - DNA, 23 bp, Artificial Sequence
  Synthetic oligonucleotide probe
ccattgtgcaggtcaggtcacag

SEQ ID NO: 127 - DNA, 40 bp, Artificial Sequence
  Synthetic oligonucleotide probe
ctggagcaagtgctcagctgcctgtggtcagactggggtc

SEQ ID NO: 128 - DNA, 2819 bp, Homo sapiens
ctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagatccctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgctttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggcaccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaaccctcgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaa

SEQ ID NO: 129 - protein, 438 aa, Homo sapiens [sequence omitted]

SEQ ID NO: 130 - DNA, 24 bp, Artificial Sequence
  Synthetic oligonucleotide probe
tcgattatggacgaacatggcagc

SEQ ID NO: 131 - DNA, 20 bp, Artificial Sequence
  Synthetic oligonucleotide probe
ttctgagatccctcatcctc

SEQ ID NO: 132 - DNA, 24 bp, Artificial Sequence
  Synthetic oligonucleotide probe
aggttcagggacagcaagtttggg

SEQ ID NO: 133 - DNA, 50 bp, Artificial Sequence
  Synthetic oligonucleotide probe
tttgctggacctcggctacggaattggcttccctctacggacagctggat

SEQ ID NO: 134 - DNA, 1493 bp, Homo sapiens
cccacgcgtccgggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaaaaaaaaaaaaaag

SEQ ID NO: 135 - protein, 228 aa, Homo sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQDPRSWFCWLDQTS

SEQ ID NO: 136 - DNA, 239 bp, Homo sapiens
  unsure 39, 61, 143, 209: unknown base
tgcttcctggagaccctgtggtgggaattcacagcttcntatgacactacctgcattggcntagcctccaggccatacgcttttcttgagtttgacagcatcattcagaaagtgaagtggcattttaactatgtaagttcctntcagatggagtgcagcttggaaaaaattcaggaggagctcaagttgcagcctccagcggttctcantatggaggacacagatgtggcaaatggggt

SEQ ID NO: 137 - DNA, 2300 bp, Homo sapiens
ctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttccccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggaaaaaaa

SEQ ID NO: 138 - protein, 489 aa, Homo sapiens [sequence omitted]

SEQ ID NO: 139 - DNA, 294 bp, Homo sapiens
  unsure 53, 57: unknown base
ggctgccgagggaaggccccttgggttggtcttggttgcttggcggcggcggnttcntccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccg

SEQ ID NO: 140 - DNA, 526 bp, Homo sapiens
  unsure 197, 349: unknown base
gaccgaccttaaagagtgggagcaaagggaggacagagccttttaaaacgaggcggtggtgcctgccctttaagggcggggcgtccggacgactgtatctgagccccagactgccccgagtttctgtcgcaggctgcgaggaaaggcccctaggctgggtctggtgcttggcggcggcggcttcctccccgttgtcntccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcntctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgcactccc

SEQ ID NO: 141 - DNA, 24 bp, Artificial Sequence
  Synthetic oligonucleotide probe
gactgtatctgagccccagactgc

SEQ ID NO: 142 - DNA, 20 bp, Artificial Sequence
  Synthetic oligonucleotide probe
tcagcaatgaggtgctgctc

SEQ ID NO: 143 - DNA, 24 bp, Artificial Sequence
  Synthetic oligonucleotide probe
tgaggaagatgagggacaggttgg

SEQ ID NO: 144 - DNA, 50 bp, Artificial Sequence
  Synthetic oligonucleotide probe
tatggaagcacctgactacgaagtgctatccgtgcgagaacagctattcc

SEQ ID NO: 145 - DNA, 685 bp, Homo sapiens
gatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagagatgggatttcctcatgctgcccaggctaatgttgaactcctgggctcaagtgatctgctcacctaggcctctcaaagcgctgggattacagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccaaaaaaaaaaaaaaaaaaaaaaaa

SEQ ID NO: 146 - protein, 124 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSEMGFPHAAQANVELLGSSDLLT

SEQ ID NO: 147 - DNA, 1621 bp, Homo sapiens
cagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttta

SEQ ID NO: 148 - protein, 358 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 149 - DNA, 509 bp, Homo sapiens
  unsure 34, 52, 134, 142, 155, 158, 196, 217, 228, 272, 347, 410, 445,482: unknown base
tgggaccagggaaccccgggccccccggtggagngcctaacaggccggtggntgcgaccgaagcggcgggcggaggaggttttgaggatttttggaacaggacccggacagaggaaccatggttccgcagaacntgagcacnttttgcctgttgntgntatacttcatcggggcggtgattgccggacgagatttntataagattttggggtgcctngaagtgccttntataaaggatattaaaaaggcctataggaaactagccctgcagntttatcccgaccggaaccctgatgatccacaagcccaggagaaattccaggatttgggtgctgcttatgaggttntgtcagatagtgagaaacggaaacagtacgataattatggtgaagaaggattaaaagatggtnatcagagctcccatggagacattttttcacacttntttggggattttggtttcatgtttggaggaacccctngtcagcaagacagaaatattccaagag

SEQ ID NO: 150 - DNA, 1532 bp, Homo sapiens
ggcacgaggcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaaaaaaaaaaaaaaa

SEQ ID NO: 151 - protein, 226 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 152 - DNA, 1027 bp, Homo sapiens
  unsure 1017, 1020: unknown base
gcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgngcncagggcc

SEQ ID NO: 153 - protein, 138 aa, Homo sapiens
  N-myristoylation Sites 11-16, 51-56 and 116-121: N-myristoylation Sites.
  Transmembrane domains 12-30, 33-52, 69-89 and 93-109: Transmembrane domains
  Aminoacyl-transfer RNA Synthetases. 49-59: Aminoacyl-transfer RNA synthetases class-II protein.
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 154 - DNA, 405 bp, Homo sapiens
  unsure 66: unknown base
gaagacgtggcggctctcgcctgggctgtttcccggcttcatttctcccgactcagcttcccaccntgggctttccgaggtgctttcgccgctgtccccaccactgcagccatgatctccttaacggacacgcagaaaattggaatgggattaaccggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttc

SEQ ID NO: 155 - DNA, 1781 bp, Homo sapiens
ggcacgaggctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaaaaaaa

SEQ ID NO: 156 - protein, 378 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 157 - DNA, 1849 bp, Homo sapiens
ctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcaaatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaaaaaaaaaaaaaaaaaaaaa

SEQ ID NO: 158 - protein, 409 aa, Homo sapiens [sequence omitted]

SEQ ID NO: 159 - DNA, 2651 bp, Homo sapiens
ggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagc

SEQ ID NO: 160 - protein, 556 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 161 - DNA, 23 bp, Artificial Sequence
  Synthetic oligonucleotide probe
ctccgtggtaaaccccacagccc

SEQ ID NO: 162 - DNA, 24 bp, Artificial Sequence
  Synthetic oligonucleotide probe
tcacatcgatgggatccatgaccg

SEQ ID NO: 163 - DNA, 50 bp, Artificial Sequence
  Synthetic oligonucleotide probe
ggtctcgtgactgtgaagccatgttacaactactgctcaaacatcatgag

SEQ ID NO: 164 - DNA, 870 bp, Homo sapiens
ctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcaaaaaaaaaaaaaaaaaa

SEQ ID NO: 165 - protein, 119 aa, Homo sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 166 - DNA, 551 bp, Homo sapiens
aatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtgacatcctcaggacacacccatgtggctcctggacaatccaagagcagccaaatcctgcttttccagtttggctccacaagtcctccaggacagagccctcaaagcaactcccaacgagttctcaggattcaggctctggcttcaaccaaacagaactcattttgaacaccctgactgcatttttgcttttagaaagttagaataaatatggcgctttgggatcacatagttgatggagaggaaaaaaaaaaaaaaaaaaaaaaaaaaaaaaaaaaaaaaaaaaaaaa

SEQ ID NO: 167 - protein, 87 aa, Homo sapiens
MAVLVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 168 - DNA, 1371 bp, Homo sapiens
ggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaacaatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacg

SEQ ID NO: 169 - protein, 277 aa, Homo sapiens [sequence omitted]

SEQ ID NO: 170 - DNA, 1621 bp, Homo sapiens
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcatgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 171 - protein, 371 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 172 - DNA, 585 bp, Homo sapiens
  unsure 71, 76, 86, 91, 162, 220, 269, 281: unknown base
tggtttttgccccataaattccctcagcttgagcagtttgttaaggaatgaggttacagattcaggaattntaggncctcaacctntagantttgtcccaaatgttctccgacatgcagtagatgggagacaagaggagattcctgtggtcatcgctgcatntgaagacaggcttgggggggccattgcagctataaacagcattcagcacaacactcgntccaatgtgattttctacattgttactctcaacaatacagcagaccatntccggtcctggntcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaa

SEQ ID NO: 173 - DNA, 1866 bp, Homo sapiens
cgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtgtctctgagcctggtgggatccccggagcgtcacatcactttccgatcacttcaaagtggttaaaaactaatatttatatgacagaagaaaaagatgtcattccgtaaagtaaacatcatcatcttggtcctgggctgttgctctcttcttactggttttgcaccataacttcctcagcttgaggcagtttgttaaggaatgaggttacagattcaggaattgtagggcctcaacctataggactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctgggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctgggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttggggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtaaaaaaaaaaaaaaaaaaaa

SEQ ID NO: 174 - DNA, 823 bp, Homo sapiens
ctgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgtctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggttggggaagcaaactggaacccatggcaataataggagggtgtccaggctgggcccctcccctggtcctcccagtgtttgctggataataaatggaactatggctctaaaaaaaaaaaaaaaaaaa

SEQ ID NO: 175 - protein, 87 aa, Homo sapiens
MGAAISQGALIAIVCNGLVGFLLLLLWVILCWACHSRLPTLTLSLNPVPTPALAPVLRRPHHPRSPAMKAATCCSPEGPWPSLEPRT

SEQ ID NO: 176 - DNA, 1660 bp, Homo sapiens
gtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcaaaa

SEQ ID NO: 177 - protein, 445 aa, Homo sapiens
MSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 178 - DNA, 2773 bp, Homo sapiens
gttcgattagctcctctgagaagaagagaaaaggttcttggacctctccctgtttcttccttagaataatttgtatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgatttgaactctgtaaccctcagcaagtttcatttttgtcatgacaatgtaggaattgctgaattaaatgtttagaaggatgaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 179 - protein, 678 aa, Homo sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 180 - DNA, 1759 bp, Homo sapiens
caggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccttgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcataaaa

SEQ ID NO: 181 - protein, 541 aa, Homo sapiens [sequence omitted]

SEQ ID NO: 182 - DNA, 2056 bp, Homo sapiens
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtaaaaaaaaaaaaaaaa

SEQ ID NO: 183 - protein, 311 aa, Homo sapiens
  Signal peptide 1-29: Signal peptide
  N-glycosylation sites 40-43, 134-137: N-glycosylation sites.
  Tissue factor proteins homology 92-119: Tissue factor proteins homology
  Transmembrane domain 230-255: Transmembrane domain
  Integrins alpha chain protein homology 232-262: Integrins alpha chain protein homology
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 184 - DNA, 808 bp, Homo sapiens
  unsure 654, 711, 748: unknown base
tcctgctgatgcacatctgggtttggcaaaaggaggttgcttcgagccgccctttctagcttcctggccggctctagaacaattcaggcttcgctgcgactagacctcagctccaacatatgcattctgaagaaagatggctgagatgacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaacctttgtgtcagggccacattgggctcacagacctcagcctggagcatcctgaagcatccctttaatagaaactcaaccatccttacccgacctgggatggagatcaccaaagatggcttncacctggttattgagctggaggacctggggccccagtttgagttccttgtggcctantggaggaggggcgaaccccttgcggcgcaaggggttngcgaaccccttgcggccgctggggtatctctcgagaaaagagaggcccaatatgacccac

SEQ ID NO: 185 - DNA, 23 bp, Artificial Sequence
  Synthetic oligonucleotide probe
aggcttcgctgcgactagacctc

SEQ ID NO: 186 - DNA, 24 bp, Artificial Sequence
  Synthetic oligonucleotide probe
ccaggtcgggtaaggatggttgag

SEQ ID NO: 187 - DNA, 50 bp, Artificial Sequence
  Synthetic oligonucleotide probe
tttctacgcattgattccatgtttgctcacagatgaagtggccattctgc

SEQ ID NO: 188 - DNA, 1227 bp, Homo sapiens
cggacgcgtgggccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctcaaaaa

SEQ ID NO: 189 - protein, 187 aa, Homo sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 190 - DNA, 24 bp, Artificial Sequence
  Synthetic oligonucleotide probe
gcaggacttctacgacttcaaggc

SEQ ID NO: 191 - DNA, 24 bp, Artificial Sequence
  Synthetic oligonucleotide probe
agtctgggccaggtacttgaaggc

SEQ ID NO: 192 - DNA, 50 bp, Artificial Sequence
  Synthetic oligonucleotide probe
caacatccggggcaaactggtgtcgctggagaagtaccgcggatcggtgt

SEQ ID NO: 193 - DNA, 2187 bp, Homo sapiens
cggacgcgtgggcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttgaaaaaaaaaaaaaaaa

SEQ ID NO: 194 - protein, 615 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 195 - DNA, 642 bp, Homo sapiens
caactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcgcggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccac

SEQ ID NO: 196 - DNA, 1575 bp, Homo sapiens
gagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggggggcccggtacccaattcgccctatagtgagtcgta

SEQ ID NO: 197 - protein, 346 aa, Homo sapiens [sequence omitted]

SEQ ID NO: 198 - DNA, 1657 bp, Homo sapiens
cgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcct

SEQ ID NO: 199 - protein, 120 aa, Homo sapiens
MELVLVFLCSLLAPMVLASAAEKEKEMDPFHYDYQTLRIGGLVFAVVLFSVGILLILSRRCKCSFNQKPRAPGDEEAQVENLITANATEPQKQRTEVQPSGGSLWNLRRLLEPLDANVDA

SEQ ID NO: 200 - DNA, 415 bp, Homo sapiens
aaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaa

SEQ ID NO: 201 - protein, 99 aa, Homo sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 202 - DNA, 678 bp, Homo sapiens
cagttctgaaatcaatggagttaatttagggaatacaaaccagccatgggggtggagattgcctttgcctcagtgattctcacctgcctctcccttctggcagcaggagtctcccaggttgttcttctccagccagttccaactcaggagacaggtcccaaggccatgggagatctctcctgtggctttgccggccactcatgagagtgtttttgtgtaaagtattttttagaatactgttgacttcttcatgatttaataaccatcctttgcgaagttttatgaggctttaggggaatgtcaaccctcaaatttttgttatactagatggcttccatttacccaccactattttaaggtccctttatttttaggttcaaggttcatttgacttgagaaagtgcccttctgcagcttcattgattttgtttatcttcactattaattgtaacgattaaaaaagaataagagcacgcagacctctaggagaatattttatccctgggtgcccctgacacatttatgtagtgatcccacaaatgtgattgttaatttaaatgttattctaatattagtacattcagttgtgatgtaatatgaataaccagaatctatttcttaaaagttttgagtatatttttcaactagatatttgtatagaaagactgaatagtgatg

SEQ ID NO: 203 - protein, 52 aa, Homo sapiens [sequence omitted]

SEQ ID NO: 204 - DNA, 1917 bp, Homo sapiens
ggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggctcctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaa

SEQ ID NO: 205 - protein, 392 aa, Homo sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 206 - DNA, 1425 bp, Homo sapiens
cacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctaaaaaaaa

SEQ ID NO: 207 - protein, 262 aa, Homo sapiens
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 208 - DNA, 2095 bp, Homo sapiens
ccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggataccttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaaaa

SEQ ID NO: 209 - protein, 331 aa, Homo sapiens
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 210 - DNA, 745 bp, Homo sapiens
cctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaaaaaa

SEQ ID NO: 211 - protein, 185 aa, Homo sapiens
MKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 212 - DNA, 1706 bp, Homo sapiens
catttctgaaactaatcgtgtcagaattgactttgaaaagcattgctttttacagaagtatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaaaaaaaaaaaaaaaaagt

SEQ ID NO: 213 - protein, 299 aa, Homo sapiens
MNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 214 - DNA, 730 bp, Homo sapiens
  unsure 72-73, 85, 91, 127, 226, 268, 454, 484, 513, 566, 663: unknown base
tggggataaaggaaaaatggtcaggtattaatggcttaaagattattggaaggggtttatcattttttgaanntattcgggtcanaattgnctttgaaaagcattgctttttacagaaatatattanctttttagagtaatttctagtttggattgtaatatgaaattatttaaaagggcttcgctcatatataggaaaatcgcatatggtcctagtattaaattnttattgcttactgatttttttgagttaagagttgttatatgntagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagantatagcatgtgcttgcatctaccttgcagntagagcacttcagattccgttgccaactngtccccattggtttcttctttttggtactacagaagaggaaatccaggaaatntgcatagaaacacttaggctttataccagaaaaaagccaaactatgaattactggaaaaagaagtagaaaaaagaaaagtagccttacaagaagccnaattaaaagcaaagggattgaatccggatggaactccagccctttcaaccctgggtggattttctcc

SEQ ID NO: 215 - DNA, 1807 bp, Homo sapiens
ggcacgaggcctcgtgccaagcttggcacgagggtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttaa

SEQ ID NO: 216 - protein, 479 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 217 - DNA, 574 bp, Homo sapiens
  unsure 5, 146: unknown base
cgttngcacgcgtcaatggcggtcctcggagtacagctggtggtgaccctgctcactgccaccctcatgcacaggctggcgccacactgctccttcgcgcgctggctgctctgtaacggcagtttgttccgatacaagcacccgtnttgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacagtgaccttctccatcaagatgttcctgacagtgacacggctgtacttcagcgccgaggaggggggtgagcgctctgtctgcctcacctttgccttcctcttcctgctgctggccatgctggtgcaagcg

SEQ ID NO: 218 - DNA, 2571 bp, Homo sapiens
ggttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaatgcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgattgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttaaa

SEQ ID NO: 219 - protein, 632 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 220 - DNA, 773 bp, Homo sapiens
ccaaagtgatcatttgaaaaagagatatccacatcttcaagcccatataaaggatagaagctgcacagggcagctttacttactccagcaccttcctctcccaggcaaatggtgctgaccatctttgggatacaatctcatggatacgaggtttttaacatcatcagcccaagcaacaatggtggcaatgttcaggagacagtgacaattgataatgaaaaaaataccgccatcgttaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccaacaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttata

SEQ ID NO: 221 - protein, 184 aa, Homo sapiens
MKILVAFLVVLTIFGIQSHGYEVFNIISPSNNGGNVQETVTIDNEKNTAIVNIHAGSCSSTTIFDYKHGYIASRVLSRRACFILKMDHQNIPPLNNLQWYIYEKQALDNMFSNKYTWVKYNPLESLIKDVDWFLLGSPIEKLCKHIPLYKGEVVENTHNVGAGGCAKAGLLGILGISICADIHV

SEQ ID NO: 222 - DNA, 992 bp, Homo sapiens
ggcacgagccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgccgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaaa

SEQ ID NO: 223 - protein, 265 aa, Homo sapiens [sequence omitted]

SEQ ID NO: 224 - DNA, 1297 bp, Homo sapiens
ggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaa

SEQ ID NO: 225 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 226 - DNA, 735 bp, Homo sapiens
gggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctggtgtggctttctttgcagaggattccaccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgaaaaaaaaaaaaaaaaaaaaaaa

SEQ ID NO: 227 - protein, 115 aa, Homo sapiens [sequence omitted]

SEQ ID NO: 228 - DNA, 2185 bp, Homo sapiens
gttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtttgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaaca

SEQ ID NO: 229 - protein, 653 aa, Homo sapiens
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 230 - DNA, 2846 bp, Homo sapiens
cgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagtctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 231 - protein, 720 aa, Homo sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 232 - DNA, 24 bp, Artificial Sequence
  Synthetic oligonucleotide probe
aggttcgtgatggagacaaccgcg

SEQ ID NO: 233 - DNA, 24 bp, Artificial Sequence
  Synthetic oligonucleotide probe
tgtcaaggacgcactgccgtcatg

SEQ ID NO: 234 - DNA, 50 bp, Artificial Sequence
  Synthetic oligonucleotide probe
tggccagatcatcaagcgtgtctgtggcaacgagcggccagctcctatcc

SEQ ID NO: 235 - DNA, 1964 bp, Homo sapiens
accaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgtccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagcaaaa

SEQ ID NO: 236 - protein, 344 aa, Homo sapiens
  Signal peptide 1-27: Signal peptide
  N-glycosylation sites 4-7, 220-223, 335-338: N-glycosylation sites
  Xylose isomerase proteins 191-201: Xylose isomerase proteins
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 237 - DNA, 25 bp, Artificial Sequence
  Synthetic oligonucleotide probe
ccttacctcagaggccagagcaagc

SEQ ID NO: 238 - DNA, 25 bp, Artificial Sequence
  Synthetic oligonucleotide probe
gagcttcatccgttctgcgttcacc

SEQ ID NO: 239 - DNA, 46 bp, Artificial Sequence
  Synthetic oligonucleotide probe
caggaatgtaaagctttacagagggtcgccatcctcgttccccacc

SEQ ID NO: 240 - DNA, 2567 bp, Homo sapiens
cgtgggccggggtcgcgcagcgggctgtgggcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcctaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcaggggcctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctcca

SEQ ID NO: 241 - protein, 423 aa, Homo sapiens
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 242 - DNA, 26 bp, Artificial Sequence
  Synthetic oligonucleotide probe
catttccttaccctggacccagctcc

SEQ ID NO: 243 - DNA, 25 bp, Artificial Sequence
  Synthetic oligonucleotide probe
gaaaggcccacagcacatctggcag

SEQ ID NO: 244 - DNA, 46 bp, Artificial Sequence
  Synthetic oligonucleotide probe
ccacgacccgagcaacttcctcaagaccgacttgtttctctacagc

SEQ ID NO: 245 - DNA, 485 bp, Homo sapiens
gctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 246 - protein, 84 aa, Homo sapiens
MALSSQIWAACLLLLLLLASLTSGSVFPQQTGQLAELQPQDRAGARASWMPMFQRRRRRDTHFPICIFCCGCCHRSKCGMCCKT

SEQ ID NO: 247 - DNA, 2359 bp, Homo sapiens
ctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggaattcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 248 - protein, 456 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 249 - DNA, 1103 bp, Homo sapiens
gcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccaccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggggactctgtccgcttgggccagtttgcctccagctccctggataaggcagtggcccacagatttggggagaagaggcggggctgtgtgtctgcgccaggggtgcagctagggtcacaatctgagggggcctcctctctgcccccctggaagactctgctcttggcccctggagagttccagctctcaggggttgggccctgaaagtccaacatctgccacttaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtgga

SEQ ID NO: 250 - protein, 240 aa, Homo sapiens
MALAALMIALGSLGLHTWQAQAVPTILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGEKRRGCVSAPGVQLGSQSEGASSLPPWKTLLLAPGEFQLSGVGP

SEQ ID NO: 251 - DNA, 50 bp, Artificial Sequence
  Synthetic oligonucleotide probe
ccaccacctggaggtcctgcagttgggcaggaactccatccggcagattg

SEQ ID NO: 252 - DNA, 1076 bp, Homo sapiens
gtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctca

SEQ ID NO: 253 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 254 - DNA, 1053 bp, Homo sapiens
ctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaaaaaaaaaaa

SEQ ID NO: 255 - DNA, 860 bp, Homo sapiens
gaaagacgtggtcctgacagacagacaatcctattccctaccaaaatgaagatgctgctgctgctgtgtttgggactgaccctagtctgtgtccatgcagaagaagctagttctacgggaaggaactttaatgtagaaaagattaatggggaatggcatactattatcctggcctctgacaaaagagaaaagatagaagaacatggcaactttagactttttctggagcaaatccatgtcttggagaattccttagttcttaaagtccatactgtaagagatgaagagtgctccgaattatctatggttgctgacaaaacagaaaaggctggtgaatattctgtgacgtatgatggattcaatacatttactatacctaagacagactatgataactttcttatggctcacctcattaacgaaaaggatggggaaaccttccagctgatggggctctatggccgagaaccagatttgagttcagacatcaaggaaaggtttgcacaactatgtgaggagcatggaatccttagagaaaatatcattgacctatccaatgccaatcgctgcctccaggcccgagaatgaagaatggcctgagcctccagtgttgagtggacacttctcaccaggactccaccatcatcccttcctatccatacagcatccccagtataaattctgtgatctgcattccatcctgtctcactgagaagtccaattccagtctatcaacatgttacctaggatacctcatcaagaatcaaagacttctttaaatttctctttgatacacccttgacaatttttcatgaaattattcctcttcctgttcaataaatgattacccttgcacttaa

SEQ ID NO: 256 - protein, 180 aa, Homo sapiens
MKMLLLLCLGLTLVCVHAEEASSTGRNFNVEKINGEWHTIILASDKREKIEEHGNFRLFLEQIHVLENSLVLKVHTVRDEECSELSMVADKTEKAGEYSVTYDGFNTFTIPKTDYDNFLMAHLINEKDGETFQLMGLYGREPDLSSDIKERFAQLCEEHGILRENIIDLSNANRCLQARE

SEQ ID NO: 257 - DNA, 766 bp, Homo sapiens
ggctcgagcgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcatttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaaaaaaaaaaa

SEQ ID NO: 258 - protein, 229 aa, Homo sapiens [sequence omitted]

SEQ ID NO: 259 - DNA, 434 bp, Homo sapiens
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgc

SEQ ID NO: 260 - protein, 83 aa, Homo sapiens
MRLSVCLLMVSLALCCYQAHALVCPAVASEITVFLFLSDAAVNLQVAKLNPPPEALAAKLEVKHCTDQISFKKRLSLKKSWWK

SEQ ID NO: 261 - DNA, 636 bp, Homo sapiens
atccgttctctgcgctgccagctcaggtgagccctcgccaaggtgacctcgcaggacactggtgaaggagcagtgaggaacctgcagagtcacacagttgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatacaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctca

SEQ ID NO: 262 - protein, 89 aa, Homo sapiens [sequence omitted]

SEQ ID NO: 263 - DNA, 1676 bp, Homo sapiens
ggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcaaa

SEQ ID NO: 264 - protein, 524 aa, Homo sapiens
MSLLSLPWLGLRPVAMSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVGLQ

SEQ ID NO: 265 - DNA, 584 bp, Homo sapiens
caacagaagccaagaaggaagccgtctatcttgtggcgatcatgtataagctggcctcctgctgtttgcttttcacaggattcttaaatcctctcttatctcttcctctccttgactccagggaaatatcctttcaactctcagcacctcatgaagacgcgcgcttaactccggaggagctagaaagagcttcccttctacagatattgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgcacaaaaaaaaaaaaaaa

SEQ ID NO: 266 - protein, 124 aa, Homo sapiens
MYKLASCCLLFTGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 267 - DNA, 654 bp, Homo sapiens
gaacatttttagttcccaaggaatgtacatcagccccacggaagctaggccacctctgggatggggttgctggtttaaaacaaacgccagtcatcctatataaggacctgacagccaccaggcaccacctccgccaggaactgcaggcccacctgtctgcaacccagctgaggccatgccctccccagggaccgtctgcagcctcctgctcctcggcatgctctggctggacttggccatggcaggctccagcttcctgagccctgaacaccagagagtccagcagagaaaggagtcgaagaagccaccagccaagctgcagccccgagctctagcaggctggctccgcccggaagatggaggtcaagcagaaggggcagaggatgaactggaagtccggttcaacgccccctttgatgttggaatcaagctgtcaggggttcagtaccagcagcacagccaggccctggggaagtttcttcaggacatcctctgggaagaggccaaagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgta

SEQ ID NO: 268 - protein, 117 aa, Homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 269 - DNA, 1332 bp, Homo sapiens
cggccacagctggcatgctctgcctgatcgccatcctgctgtatgtcctcgtccagtacctcgtgaaccccggggtgctccgcacggaccccagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgagtatgtcccccaccctaagcccccgatccccccaaggctgggtggtcagagctgctcatcttacacctctacttgagtatgtccctaaccctgagccccccacgcctggggccagagtctttgtcccccgtgtgcgcatgtgttcagggtcagcctctcccagaagtgagatcatggacaaaaagggcaaatcacaggaagaaattaaatccatgaggacccagcaggcccagcaagaagctgaactcacgccgagacctgcaggagtggtgccaggtgcttgaagtaacaagtttaaaatgttcagagacaatggaatggaatctattaggcaagaacaggacattatgaaataaggacaggtggacttccaaaaacacaagtagaaattctaacaatgaaatatattacaggcaggtcacccactaaccaaacaactgaagcgagagctgtggtcttgcttggtctcacagtgggcacagcggtaggcggtcagtcatgttgctgaacgacggagggtaaactccccagccccaagaaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcatatcttacagtcactgttgtcttgcctgagggttgaattttttttaatgaaagtgcaatgaaaatcactggattaaatcctacggacacagagctgaaaaaaaaaaaaaaaaaaaaaaaaaaaaaaaa

SEQ ID NO: 270 - protein, 142 aa, Homo sapiens
MNTWLLFLPLFPVQVQTLIVVIIGMLVLLLDFLGLVHLGQLLIFHIYLSMSPTLSPRSPQGWVVRAAHLTPLLEYVPNPEPPTPGARVFVPRVRMCSGSASPRSEIMDKKGKSQEEIKSMRTQQAQQEAELTPRPAGVVPGA

SEQ ID NO: 271 - DNA, 1484 bp, Homo sapiens
ggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgaaa

SEQ ID NO: 272 - protein, 285 aa, Homo sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 273 - DNA, 1158 bp, Homo sapiens
aactggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaatgtagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgaaa

SEQ ID NO: 274 - protein, 86 aa, Homo sapiens
MWLPLGLLSLCLSPLPILSSPSLKSQACQQLLWTLPSPLVAFRANRTTYVMDVSTNQGSGMEHRNHLCFCDLYDRATSPPLKCSLL

SEQ ID NO: 275 - DNA, 2694 bp, Homo sapiens
gtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatctattttaaaaaaaaaa

SEQ ID NO: 276 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 277 - DNA, 4104 bp, Homo sapiens
cccacgcgtccgcccacgcgtccgcccacgcgtccgcccacgcgtccgcccacgcgtccgcccacgcgtccgcccacgcgtccggtgcaagctcgcgccgcacactgcctggtggagggaaggagcccgggcgcctctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcagcaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattatctttaagcttcaagaaacttgctctgacccctctaagcaaactactaagcatttaaaagagaatctaatttttaaaggtgtagcacctttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 278 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLSNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 279 - DNA, 46 bp, Artificial Sequence
  Synthetic oligonucleotide probe
tccgtgcagggggacgcctttcagaaactgcgccgagttaaggaac

SEQ ID NO: 280 - DNA, 709 bp, Homo sapiens
gtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccct

SEQ ID NO: 281 - protein, 229 aa, Homo sapiens
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQP

SEQ ID NO: 282 - DNA, 644 bp, Homo sapiens
atcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcaaaaaaaaaaaaaaaaaaaaaaaaaaaaaaaaaaaaaaaaaaaaaaaaaaaaaaaaaaaaaaaaaaaaaaa

SEQ ID NO: 283 - protein, 77 aa, Homo sapiens
MGPVKQLKRMFEPTRLIATIMVLLCFALTLCSAFWWHNKGLALIFCILQSLALTWYSLSFIPFARDAVKKCFAVCLA

SEQ ID NO: 284 - DNA, 2623 bp, Homo sapiens
ttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgagggtgggagagaaaattagggggagaaaggacagagagagcaactaccatccatagccagatagattatcttacactgaactgatcaagtactttgaaaatgacttcgaaatttatcttggtgtccttcatacttgctgcactgagtctttcaaccaccttttctctccaactagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattgttgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcactgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatctgcagaaaccattaagcagttacatatttaggtatacacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatatattgcactttaaatttctctcctgatgggtactttaatttgaaatgcactttatggacagttatgtcttataacttgattgaaaatgacaactttttgcacccatgtcacagaatacttgttacgcattgttcaaactgaaggaaatttctaataatcccgaataatgaacatagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatacttttcttctatatagttcagcaatggcctgaatagaagcaaccaggcaccatctcagcaatgttttctcttgtttgtaattatttgctcctttgaaaattaaatcactattaattacattaaaaatcaaattggataaaaaaaaaaaaaaaaaaa

SEQ ID NO: 285 - protein, 477 aa, Homo sapiens [sequence omitted]

SEQ ID NO: 286 - DNA, 1337 bp, Homo sapiens
ggatttttgtgatccgcgattcgctcccacgggcgggacctttgtaactgcgggaggcccaggacaggcccaccctgcggggcgggaggcagccggggtgagggaggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctgagttctttcaccacaagtttgagatcctggatgcccgtcgtggtggtggtctcattcatcctggacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaagcccctggactgatgagtttgctgtatcaacctgtaaggagaagctctctccggatggctatgggaatgaaagaatccgacttctactctcacacagccaccgtgaaagtcctggagtaaaatgtgctgtgtacagaagagagagaaggaagcaggctggcatgttcactgggctggtgttacgacagagaacctgacagtcactggccagttatcacttcagattacaaatcacacagagcatctgcctgttttcaatcacaagagaacaaaaccaaaatctataaagatattctgaaaatatgacagaatttgacaaataaaagcataaacgtgtaaaaaaaaaaaaaaaaaaaaaaaaaaaaaaaaaaaa

SEQ ID NO: 287 - protein, 255 aa, Homo sapiens
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLSSFTTSLRSWMPVVVVVSFILDIVLLFQEHQFEALGLLILLRLWRVARIINGIIISVKTRSERQLLRLKQMNVQLAAKIQHLEFSCSEKPLD

SEQ ID NO: 288 - DNA, 3334 bp, Homo sapiens
cggctcgagctcgagccgaatcggctcgaggggcagtggagcacccagcaggccgccaacatgctctgtctgtgcctgtacgtgccggtcatcggggaagcccagaccgagttccagtactttgagtcgaaggggctccctgccgagctgaagtccattttcaagctcagtgtcttcatcccctcccaggaattctccacctaccgccagtggaagcagaaaattgtacaagctggagataaggaccttgatgggcagctagactttgaagaatttgtccattatctccaagatcatgagaagaagctgaggctggtgtttaagattttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctgaaaaaaaaaaaaaaaaaaaaaaaaaaaaaaaaaaaaaaaaaaaaaaaaaaaaaaaaaaaaaaaa

SEQ ID NO: 289 - protein, 469 aa, Homo sapiens
MLCLCLYVPVIGEAQTEFQYFESKGLPAELKSIFKLSVFIPSQEFSTYRQWKQKIVQAGDKDLDGQLDFEEFVHYLQDHEKKLRLVFKILDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 290 - DNA, 1658 bp, Homo sapiens
ggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggggacaccgattttataaataaactgagcaccttctttttaaacaaaaaaaaaaaaaaaaaaaaaaaaaaaaaaaaaaaaaaaaaaaaaaaaaaaa

SEQ ID NO: 291 - protein, 282 aa, Homo sapiens
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 292 - DNA, 1484 bp, Homo sapiens
gaatttgtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatgtaaacagacaaaaaaaaaaaaaaaaaaaaaaaaaaaaaaaaaaaaaaaaaaaaaaaaaaaaaaaaaaaaaaaaaaaaaa

SEQ ID NO: 293 - protein, 180 aa, Homo sapiens
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRKLDYCECGTQLCGSRHTCVSSFPEPISPEWVRTRPFPILPFPLQLFCFLVAIRVPFPWTVWRKTEAGVWD

SEQ ID NO: 294 - DNA, 1164 bp, Homo sapiens
cttctgtaggacagtcaccaggccagatccagaagcctctctaggctccagctttctctgtggaagatgacagcaattatagcaggaccctgccaggctgtcgaaaagattccgcaataaaactttgccagtgggaagtacctagtgaaacggcctaagatgccacttcttctcatgtcccaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgccaaaaaaaaaaaaaaaaaaaaaaaaaa

SEQ ID NO: 295 - protein, 237 aa, Homo sapiens
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCRGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 296 - DNA, 1245 bp, Homo sapiens
ggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacaa

SEQ ID NO: 297 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 298 - DNA, 2692 bp, Homo sapiens
cccgggtcgacccacgcgtccggggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagtcttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgttcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccgttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgtgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctcaaaaaaaaaaaaaaaaa

SEQ ID NO: 299 - protein, 320 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 300 - DNA, 1674 bp, Homo sapiens
ggccgcctggaattgtgggagttgtgtctgccactcggctgccggaggccgaaggtccgtgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 301 - protein, 461 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 302 - DNA, 2136 bp, Homo sapiens
ttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaagggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaaaaaaaaaaaaaaaaaaaaaaaaaaaaaaaaaaaaaaaaaaaaaaaaaaaaaaaaaaaaaaaaaaaaaaaaa

SEQ ID NO: 303 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 304 - DNA, 240 bp, Homo sapiens
  unsure 108, 123, 126, 154, 198, 206, 217: unknown base
aagctggtttaaggaagcagaggagggttagattcgttgagtgaggacggaagatcaacccatttccattccgccagatggcctatgtttctggtctctcccttcggnatcatcagtggtgtnttntctgttatcaatattttggctgatgcanttgggccaggtgtggttgggatccatggagactcaccctattanttcctganttcagcctttntgacagcagccattatcctgctc

SEQ ID NO: 305 - DNA, 378 bp, Homo sapiens
  unsure 58, 94, 132, 186, 191, 220, 240, 248, 280, 311, 332: unknown base
gaccgaccgttcagatgcccggttccagtacggcttcctgatttttggtgctgctgtntctgtccttctacaggaggtgttccgctttgcctantacaagctgcttaagaaggcagatgaggggttagcatngctgagtgaggacggaagatcacccatttccatccgccagatggcctatgtttntggtntttccttcggtatcatcagtggtgttttntctgttatcaatattttggntgatgcanttgggccaggtgtggttgggatccatggagantcaccctattaattcctgaattcagcctttntgacagcagccattatcctgntccataccttttggggagttgtgttttttgatgcctgtgagaggag

SEQ ID NO: 306 - DNA, 655 bp, Homo sapiens
  unsure 1, 22, 129, 133, 184: unknown base
ngttggagaagtggcgcggacnttcatttggggtttcggtttcccccctttccctttccccggggtctggggtgacattgcacgggcccctcgtggggtcgcgttgccaccccacgcggactccccagntggngcgcccttcccatttgcctgtcctggtcaggcccccaccccccttcccacntgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccc

SEQ ID NO: 307 - DNA, 650 bp, Homo sapiens
  unsure 52, 89, 128: unknown base
gtaaaagaaagtggccggaccttcattggggtttcggttcccccctttcccnttccccggggtctgggggtgacattgcaccgcgcccntcgtggggtcgcgttgccaccccacgcggactccccagntggcgcgcccctcccatttgcctgtcctggtcaggcccccaccccccttcccacctgaccagccatgggggctgcggtgtttttcgggctgcactttcgtcgcgttcgggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagac

SEQ ID NO: 308 - DNA, 1570 bp, Homo sapiens
gccccagggagcagtgggtggttataactcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaa

SEQ ID NO: 309 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 310 - DNA, 24 bp, Artificial Sequence
  Synthetic oligonucleotide probe
tcctgtgaccacccctctaacacc

SEQ ID NO: 311 - DNA, 24 bp, Artificial Sequence
  Synthetic oligonucleotide probe
ctggaacatctgctgcccagattc

SEQ ID NO: 312 - DNA, 50 bp, Artificial Sequence
  Synthetic oligonucleotide probe
gtcggatgacagcagcagccgcatcatcaatggatccgactgcgatatgc

SEQ ID NO: 313 - DNA, 3010 bp, Homo sapiens
atggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggacgcgtaccgagacggctttggcaggctcaccggggagcactggctagggctcaagaggatccacgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagactggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccactgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaatgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagccggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatgggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcag

SEQ ID NO: 314 - protein, 461 aa, Homo sapiens
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 315 - DNA, 24 bp, Artificial Sequence
  Synthetic oligonucleotide probe
cacacgtccaacctcaatgggcag

SEQ ID NO: 316 - DNA, 23 bp, Artificial Sequence
  Synthetic oligonucleotide probe
gaccagcagggccaaggacaagg

SEQ ID NO: 317 - DNA, 44 bp, Artificial Sequence
  Synthetic oligonucleotide probe
gttctctgagatgaagatccggccggtccgggagtaccgcttag

SEQ ID NO: 318 - DNA, 1841 bp, Homo sapiens
gcagtcagagacttcccctgcccctcgctgggaaagaacattaggaatgccttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatcctcaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaaaaa

SEQ ID NO: 319 - protein, 280 aa, Homo sapiens [sequence omitted]

SEQ ID NO: 320 - DNA, 468 bp, Homo sapiens
  unsure 59, 95, 149, 331, 364, 438, 446: unknown base
aattttcaccgctgtaggaatccagatgcaggccaagtacagcagcacgagggacatgntggatgatgatgggacaccaccatgagcctgcattntcaagcttttgccacaattcggcatccagagccccggcgcacagagcacagggntcctttttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatttnttcaagtccagaatataaagcttgcaggaagtntgcagcatgtggctgaaaaactctgtcgtgagctgtataacaaagctggaggaactttgaaggagggcaaagtntcctcatntactatacacacaccacttccc

SEQ ID NO: 321 - DNA, 23 bp, Artificial Sequence
  Synthetic oligonucleotide probe
atgcaggccaagtacagcagcac

SEQ ID NO: 322 - DNA, 23 bp, Artificial Sequence
  Synthetic oligonucleotide probe
catgctgacgacttcctgcaagc

SEQ ID NO: 323 - DNA, 23 bp, Artificial Sequence
  Synthetic oligonucleotide probe
ccacacagtctctgcttcttggg

SEQ ID NO: 324 - DNA, 40 bp, Artificial Sequence
  Synthetic oligonucleotide probe
atgctggatgatgatggggacaccaccatgagcctgcatt

SEQ ID NO: 325 - DNA, 2988 bp, Homo sapiens
gccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccaggtgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggaaaaa

SEQ ID NO: 326 - protein, 775 aa, Homo sapiens [sequence omitted]

SEQ ID NO: 327 - DNA, 24 bp, Artificial Sequence
  Synthetic oligonucleotide probe
tggaaggctgccgcaacgacaatc

SEQ ID NO: 328 - DNA, 20 bp, Artificial Sequence
  Synthetic oligonucleotide probe
ctgatgtggccgatgttctg

SEQ ID NO: 329 - DNA, 20 bp, Artificial Sequence
  Synthetic oligonucleotide probe
atggctcagtgtgcagacag

SEQ ID NO: 330 - DNA, 24 bp, Artificial Sequence
  Synthetic oligonucleotide probe
gcatgctgctccgtgaagtagtcc

SEQ ID NO: 331 - DNA, 24 bp, Artificial Sequence
  Synthetic oligonucleotide probe
atgcatgggaaagaaggcctgccc

SEQ ID NO: 332 - DNA, 47 bp, Artificial Sequence
  Synthetic oligonucleotide probe
tgcactggtgaccacgagggggtgcactatagccatctggagctgag

SEQ ID NO: 333 - DNA, 1095 bp, Homo sapiens
gctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaa

SEQ ID NO: 334 - protein, 153 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 335 - DNA, 442 bp, Homo sapiens
ggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccag

SEQ ID NO: 336 - DNA, 23 bp, Artificial Sequence
  Synthetic oligonucleotide probe
ctgagaccctgcagcaccatctg

SEQ ID NO: 337 - DNA, 24 bp, Artificial Sequence
  Synthetic oligonucleotide probe
ggtgcttcttgagccccacttagc

SEQ ID NO: 338 - DNA, 40 bp, Artificial Sequence
  Synthetic oligonucleotide probe
aatctagcttctccaggactgtggtcgccccgtccgctgt

SEQ ID NO: 339 - DNA, 2162 bp, Homo sapiens
gcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggaaaaaaaaaaaa

SEQ ID NO: 340 - protein, 574 aa, Homo sapiens
MPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 341 - DNA, 24 bp, Artificial Sequence
  Synthetic oligonucleotide probe
tggacaccgtaccctggtatctgc

SEQ ID NO: 342 - DNA, 24 bp, Artificial Sequence
  Artificial Sequence 1-24: Synthetic oligonucleotide probe
ccaactctgaggagagcaagtggc

SEQ ID NO: 343 - DNA, 44 bp, Artificial Sequence
  Synthetic oligonucleotide probe
tgtatgtgcacaccctcaccatcacctccaagggcaaggagaac

SEQ ID NO: 344 - DNA, 762 bp, Homo sapiens
caacatggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaactggaagaaggaggaaacaaggatgaagatgtgtcaaggccataccctgagccaggatgggaggccaagtgtccaggctcctcctctaccaggtgtcctcagaaatgatgctgggtcctttctacctctgggggtcactctcacttggcacctgcccctgagggtcctgagacttggaatatggaagaagcaatacccaaccccaccaaagaaaacctgagcttgaagtccttttccccaaaaagagggaagagtcacaaaaagtccagaccccagggacggtactttccctctctacctggtgctcctccctaatgctcatgaatggacccctcatgaatgaaaccagtgcccttataagagaccccaaagagctgccttgcccttctgcaatgtgtgatcacagctagaaggcactgtcagagaagagaaactggtcctcaccagatgctgaatctgctggtgccttgatcttggacttcccagcctctagaactgtaagaaataaatatttgctgtttataatccaa

SEQ ID NO: 345 - protein, 111 aa, Homo sapiens
MGSSSFLVLMVSLVLVTLVAVEGVKEGIEKAGVCPADNVRCFKSDPPQCHTDQDCLGERKCCYLHCGFKCVIPVKELEEGGNKDEDVSRPYPEPGWEAKCPGSSSTRCPQK

SEQ ID NO: 346 - DNA, 2528 bp, Homo sapiens
aaactcagcacttgccggagtggctcattgttaagacaaagggtgtgcacttcctggccaggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcgaggaggacaaccatctatgcagagccagcgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtgaaaaaaaaaaaaaaa

SEQ ID NO: 347 - protein, 600 aa, Homo sapiens [sequence omitted]

SEQ ID NO: 348 - DNA, 496 bp, Homo sapiens
cgatgcgcggacccgggcaccccctcctcctggggctgctgctggtgctggggccttcgccggagcagcgagtggaaattgttcctcgagatctgaggatgaaggacaagtttctaaaacaccttacaggccctctttattttagtccaaagtgcagcaaacacttccatagactttatcacaacaccagagactgcaccattcctgcatactataaaagatgcgccaggcttcttacccggctggctgtcagtccagtgtgcatggaggataagtgagcagaccgtacaggagcagcacaccaggagccatgagaagtgccttggaaaccaacagggaaacagaactatctttatacacatcccctcatggacaagagatttatttttgcagacagactcttccataagtcctttgagttttgtatgttgttgacagtttgcagatatatattcgataaatcagtgtacttgacagtgttatctgtcacttattt

SEQ ID NO: 349 - protein, 91 aa, Homo sapiens
MRGPGHPLLLGLLLVLGPSPEQRVEIVPRDLRMKDKFLKHLTGPLYFSPKCSKHFHRLYHNTRDCTIPAYYKRCARLLTRLAVSPVCMEDK

SEQ ID NO: 350 - DNA, 1141 bp, Homo sapiens
gggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatgtacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacaaaa

SEQ ID NO: 351 - protein, 197 aa, Homo sapiens
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFMYPPSGPAPQYPLYPAGPPVYNPAAPPPYMPPQPSYPGA

SEQ ID NO: 352 - DNA, 3226 bp, Homo sapiens
gggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacagtgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccaacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcaaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgcccggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctttttcatgaatgggctatcgctaccatgtgttttgttcatcacaggtgttgccctgcaacgtaaacccaagtgttgggttccctgccacagaagaataaagtaccttattcttctcaaaaaaaaaaaaaaaaaaaaaaaaaaa

SEQ ID NO: 353 - protein, 941 aa, Homo sapiens [sequence omitted]

SEQ ID NO: 354 - DNA, 1587 bp, Homo sapiens
cagccacagacgggtcatgagcgcggtattactgctggccctcctggggttcatcctcccactgccaggagtgcaggcgctgctctgccagtttgggacagttcagcatgtgtggaaggtgtccgacctaccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccaggttgcaacctgctcaatgggacacaggaaattgggcccgtgggtatgactgagaactgcaataggaaagattttctgacctgtcatcgggggaccaccattatgacacacggaaacttggctcaagaacccactgattggaccacatcgaataccgagatgtgcgaggtggggcaggtgtgtcaggagacgctgctgctcatagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttca

SEQ ID NO: 355 - protein, 437 aa, Homo sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPGCNLLNGTQEIGPVGMTENCNRKDFLTCHRGTTIMTHGNLAQEPTDWTTSNTEMCEVGQVCQETLLLIDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 356 - DNA, 1238 bp, Homo sapiens
gcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaaaaaaaaaaaaaaaaaa

SEQ ID NO: 357 - protein, 271 aa, Homo sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 358 - DNA, 972 bp, Homo sapiens
agtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaaaaaaaaaaaaaaaaaaaaaaaaaaaa

SEQ ID NO: 359 - protein, 135 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 360 - DNA, 1738 bp, Homo sapiens
gggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgccccaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatggtgagcgccggctccggccgcagaggctggcaccgggggtggggcctgggccaccagcctgctctgttccccagccagctctgttccccagccagtgcgtgtgatggctggctcagggtctcctctggcaggggaggatcccggctctgttctgttttgtttgtttgttttgagacagggtctcactctgccactgacgctggagtgcaatggcacaatcgtcatgccctgaaaccttagactcccggggttaagcgatcctgcttcagcctcccaagtagctggaactacaggcatgcaccatggtgcccagctagattttaaatattttgtggagatgggggtcttgctacgttgcccaggctggtcttgaactcctaggctcaagcaatcctcctgcctcagcctctcaaagtgctaggattataggcatgagtcaccctgtctggctctggctctgttcttaacattctgccaaaacaacacacgtgggttccctgtgcagagcctgcctcgttgccttcatgtcactcttggtagctccactgggaacacagctctcagcctttcccacctggaggcagagtggggaggggcccagggctgggctttgctgatgctgatctcagctgtgccacacgctagctgcaccaccctgacttctccttagcccgtgtgagcctcactttccacttggagagtccttcctcgcgtggttgccatgactgtgagataagtcgaggctgtgaagggcccggcacagactgacctgcctccccaacccctaggctttgctaaccgggaaaggagctaacggtgacagaagacagccaaggtcaaccctcccgggtgattgtgatgggtgttccaggtgtggttgggcgatgctgctacttgaccccaagctccagtgtggaaacttccttcctggctggttttccagaactacagaggaatggaccacagtcttccagggtccctcctcgtccaccaaccgggagcctccaccttggccatccgtcagctatgaatggctttttaaacaaacccacgtcccagcctgggtaacatggtaaagccccgtctctacaaaaaaatccaagttagccgggcatggtggtgcgcacctgtagtcccagctgcagtgggactgaggtggaggtggaggtggggggtgggagctgaggaaggaggatcgcttgagcctgggaagtcgaggctgcagtgagctgagattgcaccactgcactccagcctgggtgacagagcaagaccctgtctcaaaaa

SEQ ID NO: 361 - protein, 159 aa, Homo sapiens
MSCVLGGVIPLGLLFLVCGSQGYLLPNVTLLEELLSKYQHNESHSRVRRAIPREDKEEILMLHNKLRGQVQPQASNMEYMVSAGSGRRGWHRGWGLGHQPALFPSQLCSPASACDGWLRVSSGRGGSRLCSVLFVCFETGSHSATDAGVQWHNRHALKP

SEQ ID NO: 362 - DNA, 422 bp, Homo sapiens
aaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctg

SEQ ID NO: 363 - protein, 78 aa, Homo sapiens
MGSGLPLVLLLTLLGSSHGTGPGMTLQLKLKESFLTNSSYESSFLELLEKLCLLLHLPSGTSVTLHHARSQHHVVCNT

SEQ ID NO: 364 - DNA, 826 bp, Homo sapiens
aattgtatctgtgtaatgttaaaacaaacgaaataaaatagaaggaaaaactttctgagtttcaaaaacaacagactagtactctaaagaactctttaaaacaattaactgttaggattgcagttatgattggatattatttaattctgtttctgatgtggggttcctccactgtgttctgtgtgctattaatatttaccattgcagaagcttcattcagtgttgaaaatgaatgcttagtggatctgtgcctcttacgcatatgttacaaattatctggagttcctaatcaatgcagagttcccctcccctccgattgttctaaataattgaaagatgtctgctgtggaaaaaggcatgtatttaaatctgtatgattctcaaccatctttagttgggaaaggtccttgaaagccaatggaaatactttttttttttcttggcactaatcaagtgagtgttaccttttcacttagtaggatgtgttgttacgctagtaaaatagaaacctgtgtttattctcaggtattttagaaacaacagccatcattttattttatgtgtgtgttcttggctgtattcataaattatatattttgggctatcaaatattacttcattcaatataaataacaatagtagaagttgtttacttagatatgctttctagttgcattttctcagcctatgtaagactactttgttgtaatagcctttgaaatttacagtactgtctctctactatcttcagattacttgattcaaataaaccaattatgtttgtaattgatattaataaaaccagaataaaagttcatatctaccc

SEQ ID NO: 365 - protein, 67 aa, Homo sapiens
MIGYYLILFLMWGSSTVFCVLLIFTIAEASFSVENECLVDLCLLRICYKLSGVPNQCRVPLPSDCSK

SEQ ID NO: 366 - DNA, 2475 bp, Homo sapiens
gaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgtatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcattgaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaaaaaaaaaaaaaa

SEQ ID NO: 367 - protein, 402 aa, Homo sapiens
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIVSEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 368 - DNA, 2281 bp, Homo sapiens
gggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaaaaaaaaaaaaaaaaaaaaaaaaaaaaaaaaaaaaaaaaaaaaaaaaaaaaaaa

SEQ ID NO: 369 - protein, 447 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 370 - DNA, 1415 bp, Homo sapiens
tggcctccccagcttgccaggcacaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacatgctggctttagaataaaagcaccaactgaaaaaa

SEQ ID NO: 371 - protein, 105 aa, Homo sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 372 - DNA, 1281 bp, Homo sapiens
agcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaa

SEQ ID NO: 373 - protein, 229 aa, Homo sapiens
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 374 - DNA, 744 bp, Homo sapiens
acggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccggaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaaaaaaaaaaaaaaaaaa

SEQ ID NO: 375 - protein, 123 aa, Homo sapiens
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGCLPI

SEQ ID NO: 376 - DNA, 713 bp, Homo sapiens
aatatatcatctatttatcattaatcaataatgtattcttttattccaataacatttgggttttgggattttaattttcaaacacagcagaatgacattttttctgtcactattattattgttggtatgtgaagctatttggagatccaattcaggaagcaacacattggagaatggctactttctatcaagaaataaagagaaccacagtcaacccacacaatcatctttagaagacagtgtgactcctaccaaagctgtcaaaaccacaggcaagggcatagttaaaggacggaatcttgactcaagagggttaattcttggtgctgaagcctggggcaggggtgtaaagaaaaacacttagattcaatgattgtaaatttaaggcaaatacacatattagtattaccttagtgtaatgtatccctgtcatatatacaataaggtgaaattataagtaccctatgcagttggctggacagttctaaattggactttattaatttttaaaatcagtaactgatttatcactggctatgtgcttagatctacaggagatcatataatttgatacaaataaaagaaaagtgttctctccccttacagaattgacattttaaatgcgatacagttagaataggaaatatgacattagaaaggaagaatgacagggagaaaggaaagaagggaaaatgttgccaaggaaaaaaaaa

SEQ ID NO: 377 - protein, 90 aa, Homo sapiens
MTFFLSLLLLLVCEAIWRSNSGSNTLENGYFLSRNKENHSQPTQSSLEDSVTPTKAVKTTGKGIVKGRNLDSRGLILGAEAWGRGVKKNT

SEQ ID NO: 378 - DNA, 3265 bp, Homo sapiens
gccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 379 - protein, 919 aa, Homo sapiens
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSGVNISTLVLSVIGSVVIVNFILSTTI

SEQ ID NO: 380 - DNA, 3877 bp, Homo sapiens
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcagccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcaatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaa

SEQ ID NO: 381 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFSPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 382 - DNA, 25 bp, Artificial Sequence
  Synthetic oligonucleotide probe
ctcggggaaagggacttgatgttgg

SEQ ID NO: 383 - DNA, 26 bp, Artificial Sequence
  Synthetic oligonucleotide probe
gcgaaggtgagcctctatctcgtgcc

SEQ ID NO: 384 - DNA, 19 bp, Artificial Sequence
  Synthetic oligonucleotide probe
cagcctacacgtattgagg

SEQ ID NO: 385 - DNA, 48 bp, Artificial Sequence
  Synthetic oligonucleotide probe
cagtcagtacaatcctggcataatatacggccaccatgatgcagtccc

SEQ ID NO: 386 - DNA, 1346 bp, Homo sapiens
gaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaaggggggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttaaaaaaaaaaaaaaaaaaaaaaaaaa

SEQ ID NO: 387 - protein, 212 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGILMMPS

SEQ ID NO: 388 - DNA, 1371 bp, Homo sapiens
aactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgtcg

SEQ ID NO: 389 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 390 - DNA, 24 bp, Artificial Sequence
  Synthetic oligonucleotide probe
ccgaggccatctagaggccagagc

SEQ ID NO: 391 - DNA, 24 bp, Artificial Sequence
  Synthetic oligonucleotide probe
acaggcagagccaatggccagagc

SEQ ID NO: 392 - DNA, 45 bp, Artificial Sequence
  Synthetic oligonucleotide probe
gagaggactgcgggagtttgggacctttgtgcagacgtgctcatg

SEQ ID NO: 393 - DNA, 471 bp, Homo sapiens
gcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacataaaaaaaaaaaaa

SEQ ID NO: 394 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 395 - DNA, 25 bp, Artificial Sequence
  Synthetic oligonucleotide probe
gctccctgatcttcatgtcaccacc

SEQ ID NO: 396 - DNA, 26 bp, Artificial Sequence
  Synthetic oligonucleotide probe
cagggacacactctaccattcgggag

SEQ ID NO: 397 - DNA, 42 bp, Artificial Sequence
  Synthetic oligonucleotide probe
ccatctttctggtctctgcccagaatccgacaacagctgctc

SEQ ID NO: 398 - DNA, 907 bp, Homo sapiens
ggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagcaattaaaactgagaaatgggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacaca

SEQ ID NO: 399 - protein, 120 aa, Homo sapiens
MLPPALPPALVFTVAWSLLAERVSWVRDAEDAHRLQPFVTERTLGKVQRWSGVHTQTGGRAGGGQFCCAWLDSKRVLASPGWGAANSIKNQRVWAPATESSAQLLCCWPVGVARGGALCQ

SEQ ID NO: 400 - DNA, 893 bp, Homo sapiens
gtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatttcaaaaaaaaaaaaaaaaaaaaaaaaaaaaaaaaaaaaaa

SEQ ID NO: 401 - protein, 198 aa, Homo sapiens
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 402 - DNA, 1915 bp, Homo sapiens
ggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctaaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaatagaaaaaaagaacctacatttattttgctttagcatccttactctcaccttttatgagattgagagtggacttacatttccttttttacattttcgtatatttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaataaaaaaaaaaaaaaaaaaaaaaaaaaaaa

SEQ ID NO: 403 - protein, 206 aa, Homo sapiens [sequence omitted]

SEQ ID NO: 404 - DNA, 25 bp, Artificial Sequence
  Synthetic oligonucleotide probe
cctggttatccccaggaactccgac

SEQ ID NO: 405 - DNA, 23 bp, Artificial Sequence
  Synthetic oligonucleotide probe
ctcttgctgctgcgacaggcctc

SEQ ID NO: 406 - DNA, 46 bp, Artificial Sequence
  Synthetic oligonucleotide probe
cgccctccaagactatggtaaaaggagcctgccaggtgtcaatgac

SEQ ID NO: 407 - DNA, 570 bp, Homo sapiens
gcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagcaaaaaaaaaaaaaaaaaaaaaaaaaaaaaaaaaaaaaaaaaaaaaaaaaaaa

SEQ ID NO: 408 - protein, 104 aa, Homo sapiens
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 409 - DNA, 2089 bp, Homo sapiens
tgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccagggaggaagaggaagatgagcaggaggccagcgaggagaaggccggtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctctcacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacgaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacatgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaacgcaagcactgcaataccataacagtcaaactgattatagagaaggctactaagtgactcatgggcgaggagcatagacagtgtggagacattgggcaaggggagaattcacatcctgggtgggacagagcaggacgatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaaaaaaaaaa

SEQ ID NO: 410 - protein, 444 aa, Homo sapiens [sequence omitted]

SEQ ID NO: 411 - DNA, 636 bp, Homo sapiens
ctgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggcaaaaaaaaaaaaaaaaaaa

SEQ ID NO: 412 - protein, 151 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 413 - DNA, 1176 bp, Homo sapiens
agaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcatcactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaagaaaaaaa

SEQ ID NO: 414 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 415 - DNA, 1281 bp, Homo sapiens
gcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatcttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactcc

SEQ ID NO: 416 - protein, 208 aa, Homo sapiens
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 417 - DNA, 1728 bp, Homo sapiens
cagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatatgtgcagctttgaactagggctggggttgtgggtgcctcttctgaaaggtctaaccattattggataactggcttttttcttcctatgtcctctttggaatgtaacaataaaaataatttttgaaacatcaa

SEQ ID NO: 418 - protein, 198 aa, Homo sapiens
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 419 - DNA, 681 bp, Homo sapiens
gcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcgataaaaatcattgtctacattaaaacttcttatagttcataaaattatttcaaatccatcatctctttaaatcctgcctcctcttcatgaggtacttaggatagccattatttcagtttcacataagaatgtttactcaatgtttaagtgttttgccccaaaattcacaactaacaaggcagaactaggacttgaacatggatcttttggttcttaatccagtgagtgatacaattcaatgcactcccctgcca

SEQ ID NO: 420 - protein, 128 aa, Homo sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 421 - DNA, 1630 bp, Homo sapiens
cggctcgagtgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcaa

SEQ ID NO: 422 - protein, 394 aa, Homo sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 423 - DNA, 963 bp, Homo sapiens
ctatgaagaagcttcctggaaaacaataagcaaaggaaaacaaatgtgtcccatctcacatggttctaccctactaaagacaggaagatcataaactgacagatactgaaattgtaagagttggaaactacattttgcaaagtcattgaactctgagctcagttgcagtactcgggaagccatgcaggatgaagatggatacatcaccttaaatattaaaactcggaaaccagctctcgtctccgttggccctgcatcctcctcctggtggcgtgtgatggctttgattctgctgatcctgtgcgtggggatggttgtcgggctggtggctctggggatttggtctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaaaaaaaaaaaa

SEQ ID NO: 424 - protein, 229 aa, Homo sapiens
MQDEDGYITLNIKTRKPALVSVGPASSSWWRVMALILLILCVGMVVGLVALGIWSVMQRNYLQDENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 425 - DNA, 24 bp, Artificial Sequence
  Synthetic oligonucleotide probe
tgcagcccctgtgacacaaactgg

SEQ ID NO: 426 - DNA, 26 bp, Artificial Sequence
  Synthetic oligonucleotide probe
ctgagataaccgagccatcctcccac

SEQ ID NO: 427 - DNA, 49 bp, Artificial Sequence
  Synthetic oligonucleotide probe
gcttcctgacactaaggctgtctgctagtcagaattgcctcaaaaagag

SEQ ID NO: 428 - DNA, 21 bp, Artificial Sequence
  Synthetic oligonucleotide probe
ccaccaatggcagccccacct

SEQ ID NO: 429 - DNA, 17 bp, Artificial Sequence
  Synthetic oligonucleotide probe
gactgccctccctgcca

SEQ ID NO: 430 - DNA, 24 bp, Artificial Sequence
  Synthetic oligonucleotide probe
caaaaagcctggaagtcttcaaag

SEQ ID NO: 431 - DNA, 20 bp, Artificial Sequence
  Synthetic oligonucleotide probe
cagctggactgcaggtgcta

SEQ ID NO: 432 - DNA, 22 bp, Artificial Sequence
  Synthetic oligonucleotide probe
cagtgagcacagcaagtgtcct

SEQ ID NO: 433 - DNA, 28 bp, Artificial Sequence
  Synthetic oligonucleotide probe
ggccacctccttgagtcttcagttccct

SEQ ID NO: 434 - DNA, 24 bp, Artificial Sequence
  Synthetic oligonucleotide probe
caactactggctaaagctggtgaa

SEQ ID NO: 435 - DNA, 27 bp, Artificial Sequence
  Synthetic oligonucleotide probe
cctttctgtataggtgatacccaatga

SEQ ID NO: 436 - DNA, 24 bp, Artificial Sequence
  Synthetic oligonucleotide probe
tggccatccctaccagaggcaaaa

SEQ ID NO: 437 - DNA, 22 bp, Artificial Sequence
  Synthetic oligonucleotide probe
ctgaagacgacgcggattacta

SEQ ID NO: 438 - DNA, 19 bp, Artificial Sequence
  Synthetic oligonucleotide probe
ggcagaaatgggaggcaga

SEQ ID NO: 439 - DNA, 30 bp, Artificial Sequence
  Synthetic oligonucleotide probe
tgctctgttggctacggctttagtccctag

SEQ ID NO: 440 - DNA, 22 bp, Artificial Sequence
  Synthetic oligonucleotide probe
agcagcagccatgtagaatgaa

SEQ ID NO: 441 - DNA, 22 bp, Artificial Sequence
  Synthetic oligonucleotide probe
aatacgaacagtgcacgctgat

SEQ ID NO: 442 - DNA, 23 bp, Artificial Sequence
  Synthetic oligonucleotide probe
tccagagagccaagcacggcaga

SEQ ID NO: 443 - DNA, 22 bp, Artificial Sequence
  Synthetic oligonucleotide probe
tctagccagcttggctccaata

SEQ ID NO: 444 - DNA, 23 bp, Artificial Sequence
  Synthetic oligonucleotide probe
cctggctctagcaccaactcata

SEQ ID NO: 445 - DNA, 25 bp, Artificial Sequence
  Synthetic oligonucleotide probe
tcagtggccctaaggagatgggcct

SEQ ID NO: 446 - DNA, 24 bp, Artificial Sequence
  Synthetic oligonucleotide probe
caggatacagtgggaatcttgaga

SEQ ID NO: 447 - DNA, 22 bp, Artificial Sequence
  Synthetic oligonucleotide probe
cctgaagggcttggagcttagt

SEQ ID NO: 448 - DNA, 24 bp, Artificial Sequence
  Synthetic oligonucleotide probe
tctttggccatttcccatggctca

SEQ ID NO: 449 - DNA, 18 bp, Artificial Sequence
  Synthetic oligonucleotide probe
cccatggcgaggaggaat

SEQ ID NO: 450 - DNA, 19 bp, Artificial Sequence
  Synthetic oligonucleotide probe
tgcgtacgtgtgccttcag

SEQ ID NO: 451 - DNA, 24 bp, Artificial Sequence
  Synthetic oligonucleotide probe
cagcaccccaggcagtctgtgtgt

SEQ ID NO: 452 - DNA, 24 bp, Artificial Sequence
  Synthetic oligonucleotide probe
aacgtgctacacgaccagtgtact

SEQ ID NO: 453 - DNA, 27 bp, Artificial Sequence
  Synthetic oligonucleotide probe
cacagcatattcagatgactaaatcca

SEQ ID NO: 454 - DNA, 31 bp, Artificial Sequence
  Synthetic oligonucleotide probe
ttgtttagttctccaccgtgtctccacagaa

SEQ ID NO: 455 - DNA, 21 bp, Artificial Sequence
  Synthetic oligonucleotide probe
tgtcagaatgcaacctggctt

SEQ ID NO: 456 - DNA, 20 bp, Artificial Sequence
  Synthetic oligonucleotide probe
tgatgtgcctggctcagaac

SEQ ID NO: 457 - DNA, 24 bp, Artificial Sequence
  Synthetic oligonucleotide probe
tgcacctagatgtccccagcaccc

SEQ ID NO: 458 - DNA, 20 bp, Artificial Sequence
  Synthetic oligonucleotide probe
aagatgcgccaggcttctta

SEQ ID NO: 459 - DNA, 24 bp, Artificial Sequence
  Synthetic oligonucleotide probe
ctcctgtacggtctgctcacttat

SEQ ID NO: 460 - DNA, 24 bp, Artificial Sequence
  Synthetic oligonucleotide probe
tggctgtcagtccagtgtgcatgg

SEQ ID NO: 461 - DNA, 29 bp, Artificial Sequence
  Synthetic oligonucleotide probe
gcatagggatagataagatcctgctttat

SEQ ID NO: 462 - DNA, 27 bp, Artificial Sequence
  Synthetic oligonucleotide probe
caaattaaagtacccatcaggagagaa

SEQ ID NO: 463 - DNA, 37 bp, Artificial Sequence
  Synthetic oligonucleotide probe
aagttgctaaatatatacattatctgcgccaagtcca

SEQ ID NO: 464 - DNA, 20 bp, Artificial Sequence
  Synthetic oligonucleotide probe
gtgctgcccacaattcatga

SEQ ID NO: 465 - DNA, 26 bp, Artificial Sequence
  Synthetic oligonucleotide probe
gtccttggtatgggtctgaattatat

SEQ ID NO: 466 - DNA, 31 bp, Artificial Sequence
  Synthetic oligonucleotide probe
actctctgcaccccacagtcaccactatctc

SEQ ID NO: 467 - DNA, 22 bp, Artificial Sequence
  Synthetic oligonucleotide probe
ctgaggaaccagccatgtctct

SEQ ID NO: 468 - DNA, 23 bp, Artificial Sequence
  Synthetic oligonucleotide probe
gaccagatgcaggtacaggatga

SEQ ID NO: 469 - DNA, 25 bp, Artificial Sequence
  Synthetic oligonucleotide probe
ctgccccttcagtgatgccaacctt

SEQ ID NO: 470 - DNA, 22 bp, Artificial Sequence
  Synthetic oligonucleotide probe
gggtggaggctcactgagtaga

SEQ ID NO: 471 - DNA, 28 bp, Artificial Sequence
  Synthetic oligonucleotide probe
caatacaggtaatgaaactctgcttctt

SEQ ID NO: 472 - DNA, 36 bp, Artificial Sequence
  Synthetic oligonucleotide probe
tcctcttaagcataggccattttctcagtttagaca

SEQ ID NO: 473 - DNA, 21 bp, Artificial Sequence
  Synthetic oligonucleotide probe
ggtggtcttgcttggtctcac

SEQ ID NO: 474 - DNA, 20 bp, Artificial Sequence
  Synthetic oligonucleotide probe
ccgtcgttcagcaacatgac

SEQ ID NO: 475 - DNA, 20 bp, Artificial Sequence
  Synthetic oligonucleotide probe
accgcctaccgctgtgccca

SEQ ID NO: 476 - DNA, 23 bp, Artificial Sequence
  Synthetic oligonucleotide probe
cagtaaaaccacaggctggattt

SEQ ID NO: 477 - DNA, 24 bp, Artificial Sequence
  Synthetic oligonucleotide probe
cctgagagcaagaaggttgagaat

SEQ ID NO: 478 - DNA, 22 bp, Artificial Sequence
  Synthetic oligonucleotide probe
tagacagggaccatggcccgca

SEQ ID NO: 479 - DNA, 21 bp, Artificial Sequence
  Synthetic oligonucleotide probe
tgggctgtagaagagttgttg

SEQ ID NO: 480 - DNA, 20 bp, Artificial Sequence
  Synthetic oligonucleotide probe
tccacacttggccagtttat

SEQ ID NO: 481 - DNA, 24 bp, Artificial Sequence
  Synthetic oligonucleotide probe
cccaacttctcccttttggaccct

SEQ ID NO: 482 - DNA, 24 bp, Artificial Sequence
  Synthetic oligonucleotide probe
gtcccttcactgtttagagcatga

SEQ ID NO: 483 - DNA, 26 bp, Artificial Sequence
  Synthetic oligonucleotide probe
actctccccctcaacagcctcctgag

SEQ ID NO: 484 - DNA, 20 bp, Artificial Sequence
  Synthetic oligonucleotide probe
gtggtcagggcagatccttt

SEQ ID NO: 485 - DNA, 23 bp, Artificial Sequence
  Synthetic oligonucleotide probe
acagatccaggagagactccaca

SEQ ID NO: 486 - DNA, 21 bp, Artificial Sequence
  Synthetic oligonucleotide probe
agcggcgctcccagcctgaat

SEQ ID NO: 487 - DNA, 23 bp, Artificial Sequence
  Synthetic oligonucleotide probe
catgattggtcctcagttccatc

SEQ ID NO: 488 - DNA, 20 bp, Artificial Sequence
  Synthetic oligonucleotide probe
atagagggctcccagaagtg

SEQ ID NO: 489 - DNA, 21 bp, Artificial Sequence
  Synthetic oligonucleotide probe
cagggccttcagggccttcac

SEQ ID NO: 490 - DNA, 19 bp, Artificial Sequence
  Synthetic oligonucleotide probe
gctcagccaaacactgtca

SEQ ID NO: 491 - DNA, 17 bp, Artificial Sequence
  Synthetic oligonucleotide probe
ggggccctgacagtgtt

SEQ ID NO: 492 - DNA, 26 bp, Artificial Sequence
  Synthetic oligonucleotide probe
ctgagccgagactggagcatctacac

SEQ ID NO: 493 - DNA, 17 bp, Artificial Sequence
  Synthetic oligonucleotide probe
gtgggcagcgtcttgtc

SEQ ID NO: 494 - DNA, 1231 bp, Homo Sapien
cccacgcgtccgcgcagtcgcgcagttctgcctccgcctgccagtctcgcccgcgatcccggcccggggctgtggcgtcgactccgacccaggcagccagcagcccgcgcgggagccggaccgccgccggaggagctcggacggcatgctgagccccctcctttgctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagc

SEQ ID NO: 495 - protein, 245 aa, Homo Sapien
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 496 - DNA, 1471 bp, Homo Sapien
ccaggatggagctggggcctgtatagccatattattgttctatgctactagacatgggggggacttggtgaaaaaggtattatccagccagagggtctgggagccctgtcttactgaacctgggcaacctggatattctgagacatattttggggggatttcagtgaaaaaagtgggggatcccctccatttagagtgtagcaaaggaaaaaacaccaaggttgggttccttcctgacattggcagtgccccagtaggggtgggatgagcgaatattcccaaagctaaagtcccacaccctgtagattacaagagtggatttggcaggagtgtgccccaaaatacagtggaaaggtgcctgaagatatttaaaccacgtcttggaaatttagtgggtcttggctttgggataggtgaagtgaggacagacactggagaggagggaaaggggacgttttcaataggaggcaaaactcgagggtgggatccactgaggagtacataggctgctggatctggtggagccagcactgggcccacgggtggtaactggctgctgtggaggggggtacgtgaggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgt

SEQ ID NO: 497 - protein, 225 aa, Homo Sapien
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 498 - DNA, 744 bp, Homo Sapien
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatag

SEQ ID NO: 499 - protein, 247 aa, Homo Sapien
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 500 - DNA, 2906 bp, Homo Sapien
ggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccacccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcctttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctccttttttttaaatttttattccttttggtatcaagatcatgcgttttctcttgttcttaaccacctggatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgaggcacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagacaaaaa

SEQ ID NO: 501 - protein, 640 aa, Homo Sapien
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 502 - DNA, 2458 bp, Homo Sapien
gcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccgagattatgccattgcactccagcctgggtgacagagcgggactccgtctc

SEQ ID NO: 503 - protein, 373 aa, Homo Sapien
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 504 - DNA, 3060 bp, Homo Sapien
cgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgctatttagttaaatacattgaagggaaatacccgttcttttccccttttatgcacacaacagaaacacgcgttgtcatgcctcaaactattttttatttgcaactacatgatttcacacaattctcttaaacaacgacataaaatagatttccttgtatataaataacttacatacgctccataaagtaaattctcaaaggtgctagaacaaatcgtccacttctacagtgttctcgtatccaacagagttgatgcacaatatataaatactcaagtccaatattaaaaacttaggcacttgactaactttaataaaatttctcaaactatatcaatatctaaagtgcatatattttttaagaaagattattctcaataacttctataaaaataagtttgatggtttggcccatctaacttcactactattagtaagaacttttaacttttaatgtgtagtaaggtttattctacctttttctcaacatgacaccaacacaatcaaaaacgaagttagtgaggtgctaacatgtgaggattaatccagtgattccggtcacaatgcattccaggaggaggtacccatgtcactggaattgggcgatatggtttattttttcttccctgatttggataaccaaatggaacaggaggaggatagtgattctgatggccattccctcgatacattcctggcttttttctgggcaaagggtgccacattggaagaggtggaaatataagttctgaaatctgtagggaagagaacacattaagttaattcaaaggaaaaaatcatcatctatgttccagatttctcattaaagacaaagttacccacaacactgagatcacatctaagtgacactcctattgtcaggtctaaatacattaaaaacctcatgtgtaataggcgtataatgtataacaggtgaccaatgttttctgaatgcataaagaaatgaataaactcaaacacagtacttcctaaacaacttcaaccaaaaaagaccaaaacatggaacgaatggaagcttgtaaggacatgcttgttttagtccagtggtttccacagctggctaagccaggagtcacttggaggcttttaaatacaaaacattggagctggaggccattatccttagcaaactaatgcagaaacagaaaatcaactaccgcatgttctcacttataagtgggaggtaatgataagaacttatgaacacaaagaaggaaacaatagacattggagtctatttgagaggggagggtgggagaaggaaaaggagcagaaaagataactattgagtactgccttcacacctgggtgatgaaataatatgtacaacaaatccctgtgacacatgtttacctatggaacaaaccttcatgtgtatccctaaacctaaaataaaagttaaaaaaaaaaaaaraaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 505 - protein, 352 aa, Homo Sapien
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 506 - DNA, 1705 bp, Homo Sapien
tgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaaccaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactccaaaaaaaaaaaaaaaaaaaaaaaaaaa

SEQ ID NO: 507 - protein, 206 aa, Homo Sapien [sequence omitted]

SEQ ID NO: 508 - DNA, 924 bp, Homo Sapien
aaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaataggcaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatga

SEQ ID NO: 509 - protein, 177 aa, Homo Sapien
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 510 - DNA, 996 bp, Homo Sapien
cccgtgccaagagtgacgtaagtaccgcctatagagtctataggcccacttggcttcgttagaacgcggctacaattaatacataaccttatgtatcatacacatacgatttaggtgacactatagaataacatccactttgcctttctctccacaggtgtccactcccaggtccaactgcacctcggttctatcgataatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctgg

SEQ ID NO: 511 - protein, 251 aa, Homo Sapien
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 512 - DNA, 2015 bp, Homo Sapien
ggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggcccaaaaaaaa

SEQ ID NO: 513 - protein, 482 aa, Homo Sapien
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPQQPRPRLPGRGRPQT

SEQ ID NO: 514 - DNA, 2284 bp, Homo Sapien
gcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacctggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacttaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctttcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttcctttttttttttggagacagagtcttgctctgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcaa

SEQ ID NO: 515 - protein, 431 aa, Homo Sapien
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 516 - DNA, 2749 bp, Homo Sapien
  unsure 1869, 1887: unknown base
ctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctggctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatccagcccttcaggaagcctgtgaaaaacgtgattcctggccccaccaagacccaccaaaaccatctctgggcttggtgcaggactctgaattctaacaatgcccagtgactgtcgcacttgagtttgagggccagtgggcctgatgaacgctcacaccccttcagcttagagtctgcatttgggctgtgacgtctccacctgccccaatagatctgctctgtctgcgacaccagatccacgtggggactcccctgaggcctgctaagtccaggccttggtcaggtcaggtgcacattgcaggataagcccaggaccggcacagaagtggttgcctttnccatttgccctccctggnccatgccttcttgcctttggaaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtggtggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcataaaaaaaaaaaaaa

SEQ ID NO: 517 - protein, 332 aa, Homo Sapien [sequence omitted]

SEQ ID NO: 518 - DNA, 24 bp, Artificial Sequence
  Synthetic oligonucleotide probe
ccctgcagtgcacctacagggaag

SEQ ID NO: 519 - DNA, 24 bp, Artificial Sequence
  Synthetic oligonucleotide probe
ctgtcttcccctgcttggctgtgg

SEQ ID NO: 520 - DNA, 47 bp, Artificial Sequence
  Synthetic oligonucleotide probe
ggtgcaggaagggtgggatcctcttctctcgctgctctggccacatc

SEQ ID NO: 521 - DNA, 24 bp, Artificial Sequence
  Synthetic oligonucleotide probe
ccagtgcacagcaggcaacgaagc

SEQ ID NO: 522 - DNA, 24 bp, Artificial Sequence
  Synthetic oligonucleotide probe
actaggctgtatgcctgggtgggc

SEQ ID NO: 523 - DNA, 43 bp, Artificial Sequence
  Synthetic oligonucleotide probe
gtatgtacaaagcatcggcatggttgcaggagcagtgacaggc

SEQ ID NO: 524 - DNA, 26 bp, Artificial Sequence
  Synthetic oligonucleotide probe
aatctcagcaccagccactcagagca

SEQ ID NO: 525 - DNA, 25 bp, Artificial Sequence
  Synthetic oligonucleotide probe
gttaaagagggtgcccttccagcga

SEQ ID NO: 526 - DNA, 24 bp, Artificial Sequence
  Synthetic oligonucleotide probe
tatcccaatgcctccccactgctc

SEQ ID NO: 527 - DNA, 24 bp, Artificial Sequence
  Synthetic oligonucleotide probe
gatgaacttggcgaaggggcggca

SEQ ID NO: 528 - DNA, 30 bp, Artificial Sequence
  Synthetic oligonucleotide probe
agggaggattatccttgacctttgaagacc

SEQ ID NO: 529 - DNA, 18 bp, Artificial Sequence
  Synthetic oligonucleotide probe
gaagcaagtgcccagctc

SEQ ID NO: 530 - DNA, 18 bp, Artificial Sequence
  Synthetic oligonucleotide probe
cgggtccctgctctttgg

SEQ ID NO: 531 - DNA, 24 bp, Artificial Sequence
  Synthetic oligonucleotide probe
caccgtagctgggagcgcactcac

SEQ ID NO: 532 - DNA, 18 bp, Artificial Sequence
  Synthetic oligonucleotide probe
agtgtaagtcaagctccc

What is claimed is:

1. An isolated nucleic acid comprising:
   (a) the nucleic acid sequence of SEQ ID NO: 193;
   (b) the full-length coding sequence of the nucleic acid sequence of SEQ ID NO:193; or
   (c) the full-length coding sequence of the cDNA deposited under ATCC accession number 209977.

2. The isolated nucleic acid of claim 1 comprising the nucleic acid sequence of SEQ ID NO:193.

3. The isolated nucleic acid of claim 1 comprising the full-length coding sequence of the nucleic acid sequence of SEQ ID NO:193.

4. The isolated nucleic acid of claim 1 comprising the full-length coding sequence of the cDNA deposited under ATCC accession number 209977.

5. A vector comprising the nucleic acid of claim 1.

6. The vector of claim 5, wherein said nucleic acid is operably linked to control sequences recognized by a host cell transformed with the vector.

7. A host cell comprising the vector of claim 5.

8. The host cell of claim 7, wherein said cell is a CHO cell, an *E. coli* or a yeast cell.

9. An isolated nucleic acid molecule consisting of a fragment of the nucleic acid sequence of SEQ ID NO: 193, or a complement thereof, of at least 20 nucleotides length that hybridizes under stringent conditions to:
   (a) the nucleic acid sequence of SEQ ID NO:193 or a complement thereof;
   (b) the full-length coding sequence of the cDNA deposited under ATCC accession number 209977 or a complement thereof;

wherein, said stringent conditions use 50% formamide, 5×SSC, 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., and washes at 42° C. in 0.2×SSC, at 55° C. in 50% formamide followed by a high-stringency wash at 55° C. in 0.1×SSC, EDTA; wherein said isolated nucleic acid molecule is suitable for use as a PCR primer or probe.

10. The isolated nucleic acid molecule of claim 9 that is at least 50 nucleotides or above in length.

11. The isolated nucleic acid molecule of claim 9 that is at least 60 nucleotides or above in length.

12. The isolated nucleic acid molecule of claim 9 that is at least 70 nucleotides or above in length.

13. The isolated nucleic acid molecule of claim 9 that is at least 80 nucleotides or above in length.

14. The isolated nucleic acid molecule of claim 9 that is at least 90 nucleotides or above in length.

15. The isolated nucleic acid molecule of claim 9 that is at least 100 nucleotides or above in length.

* * * * *

UNITED STATES PATENT AND TRADEMARK OFFICE
CERTIFICATE OF CORRECTION

PATENT NO. : 6,913,919 B2
DATED : July 5, 2005
INVENTOR(S) : Botstein et al.

Page 1 of 1

It is certified that error appears in the above-identified patent and that said Letters Patent is hereby corrected as shown below:

<u>Title page,</u>
Item [63], Related U.S. Application Data, should read -- This application is a CON of 09/941,992, filed on August 28, 2001, which is a continuation of application No. PCT/US00/08439, filed on March 30, 2000, which claims benefit of 60/141,037 filed June 23, 1999, where application No. PCT/US00/08439 is a continuation-in-part of 09/380,137 filed August 25, 1999, now abandoned, which is a 371 of application No. PCT/US99/12252, filed June 2, 1999, which claims benefit of 60/089,600 filed June 17, 1998. --.

Signed and Sealed this

Twenty-fifth Day of April, 2006

JON W. DUDAS
*Director of the United States Patent and Trademark Office*